US012485136B2

(12) United States Patent
Bermingham et al.

(10) Patent No.: US 12,485,136 B2
(45) Date of Patent: Dec. 2, 2025

(54) METHODS FOR THE TREATMENT OF TRINUCLEOTIDE REPEAT EXPANSION DISORDERS ASSOCIATED WITH MLH3 ACTIVITY

(71) Applicant: TAKEDA PHARMACEUTICALS U.S.A., INC., Cambridge, MA (US)

(72) Inventors: Nessan Anthony Bermingham, Cambridge, MA (US); Brian R. Bettencourt, Cambridge, MA (US); Peter Edward Bialek, Cambridge, MA (US)

(73) Assignee: Takeda Pharmaceuticals U.S.A., Inc., Cambridge, MA (US)

( * ) Notice: Subject to any disclaimer, the term of this patent is extended or adjusted under 35 U.S.C. 154(b) by 212 days.

(21) Appl. No.: 17/299,277

(22) PCT Filed: Dec. 2, 2019

(86) PCT No.: PCT/US2019/064059
§ 371 (c)(1),
(2) Date: Jun. 2, 2021

(87) PCT Pub. No.: WO2020/117706
PCT Pub. Date: Jun. 11, 2020

(65) Prior Publication Data

US 2023/0042436 A1 Feb. 9, 2023

Related U.S. Application Data

(60) Provisional application No. 62/877,104, filed on Jul. 22, 2019, provisional application No. 62/774,777, filed on Dec. 3, 2018.

(51) Int. Cl.
*A61K 31/7125* (2006.01)
*A61P 25/28* (2006.01)
*C12N 15/113* (2010.01)

(52) U.S. Cl.
CPC .......... *A61K 31/7125* (2013.01); *A61P 25/28* (2018.01); *C12N 15/113* (2013.01)

(58) Field of Classification Search
CPC .............. C12N 15/113; C12N 2310/11; C12N 2310/322; C12N 2310/3525; A61K 31/7125; A61K 31/7088; A61P 25/28
See application file for complete search history.

(56) References Cited

U.S. PATENT DOCUMENTS 3,687,808 A 8/1972 Merigan, Jr. et al.
4,469,863 A 9/1984 Ts'o et al.
4,476,301 A 10/1984 Imbach et al.
4,587,044 A 5/1986 Miller et al.
4,605,735 A 8/1986 Miyoshi et al.
4,667,025 A 5/1987 Miyoshi et al.
4,683,202 A 7/1987 Mullis
4,762,779 A 8/1988 Snitman
4,789,737 A 12/1988 Miyoshi et al.
4,824,941 A 4/1989 Gordon et al.
4,828,979 A 5/1989 Klevan et al.
4,835,263 A 5/1989 Nguyen et al.
4,837,028 A 6/1989 Allen
4,845,205 A 7/1989 Dinh et al.
4,876,335 A 10/1989 Yamane et al.
4,897,355 A 1/1990 Eppstein et al.
4,904,582 A 2/1990 Tullis
4,948,882 A 8/1990 Ruth
4,958,013 A 9/1990 Letsinger
4,981,957 A 1/1991 Lebleu et al.
5,023,243 A 6/1991 Tullis
5,034,506 A 7/1991 Summerton et al.
5,082,830 A 1/1992 Brakel et al.
5,109,124 A 4/1992 Ramachandran et al.
5,112,963 A 5/1992 Pieles et al.
5,118,800 A 6/1992 Smith et al.
5,118,802 A 6/1992 Smith et al.
5,130,302 A 7/1992 Spiel et al.
5,134,066 A 7/1992 Rogers et al.
5,138,045 A 8/1992 Cook et al.
5,166,315 A 11/1992 Summerton et al.
5,171,678 A 12/1992 Behr et al.
5,175,273 A 12/1992 Bischofberger et al.
5,177,195 A 1/1993 Gregory et al.
(Continued)

FOREIGN PATENT DOCUMENTS

WO WO-8804924 A1 7/1988
WO WO-9116024 A1 10/1991
(Continued)

OTHER PUBLICATIONS

Halabi et al., Feb. 26, 2018, "GAA•TTC repeat expansion in human cells is mediated by mismatch repair complex MutLy and depends upon the endonuclease domain in MLH3 isoform one" Nucleic Acids Research, 46(8), p. 4022-4032 (Year: 2018).*
(Continued)

*Primary Examiner* — Soren Harward
*Assistant Examiner* — Jenna L Persons
(74) *Attorney, Agent, or Firm* — Sterne, Kessler, Goldstein & Fox P.L.L.C.

(57) ABSTRACT

The present disclosure features useful compositions and methods to treat repeat expansion disorders, e.g., in a subject in need thereof. In some aspects, the compositions and methods described herein are useful in the treatment of disorders associated with MLH3 activity.

9 Claims, 2 Drawing Sheets

Specification includes a Sequence Listing.

(56) References Cited

U.S. PATENT DOCUMENTS

| | | | |
|---|---|---|---|
| 5,185,444 | A | 2/1993 | Summerton et al. |
| 5,188,897 | A | 2/1993 | Suhadolnik et al. |
| 5,214,134 | A | 5/1993 | Weis et al. |
| 5,214,136 | A | 5/1993 | Lin et al. |
| 5,216,141 | A | 6/1993 | Benner |
| 5,218,105 | A | 6/1993 | Cook et al. |
| 5,235,033 | A | 8/1993 | Summerton et al. |
| 5,245,022 | A | 9/1993 | Weis et al. |
| 5,254,469 | A | 10/1993 | Warren, III et al. |
| 5,258,506 | A | 11/1993 | Urdea et al. |
| 5,262,536 | A | 11/1993 | Hobbs, Jr. |
| 5,264,423 | A | 11/1993 | Cohen et al. |
| 5,264,562 | A | 11/1993 | Matteucci |
| 5,264,564 | A | 11/1993 | Matteucci |
| 5,272,250 | A | 12/1993 | Spiel et al. |
| 5,276,019 | A | 1/1994 | Cohen et al. |
| 5,278,302 | A | 1/1994 | Caruthers et al. |
| 5,283,185 | A | 2/1994 | Epand et al. |
| 5,286,717 | A | 2/1994 | Cohen et al. |
| 5,292,873 | A | 3/1994 | Rokita et al. |
| 5,317,098 | A | 5/1994 | Shizuya et al. |
| 5,319,080 | A | 6/1994 | Leumann |
| 5,321,131 | A | 6/1994 | Agrawal et al. |
| 5,359,044 | A | 10/1994 | Cook et al. |
| 5,367,066 | A | 11/1994 | Urdea et al. |
| 5,371,241 | A | 12/1994 | Brush |
| 5,391,723 | A | 2/1995 | Priest |
| 5,393,878 | A | 2/1995 | Leumann |
| 5,399,676 | A | 3/1995 | Froehler |
| 5,405,938 | A | 4/1995 | Summerton et al. |
| 5,405,939 | A | 4/1995 | Suhadolnik et al. |
| 5,414,077 | A | 5/1995 | Lin et al. |
| 5,416,203 | A | 5/1995 | Letsinger |
| 5,432,272 | A | 7/1995 | Benner |
| 5,434,257 | A | 7/1995 | Matteucci et al. |
| 5,445,934 | A | 8/1995 | Fodor et al. |
| 5,446,137 | A | 8/1995 | Maag et al. |
| 5,451,463 | A | 9/1995 | Nelson et al. |
| 5,453,496 | A | 9/1995 | Caruthers et al. |
| 5,455,233 | A | 10/1995 | Spiel et al. |
| 5,457,187 | A | 10/1995 | Gmeiner et al. |
| 5,459,255 | A | 10/1995 | Cook et al. |
| 5,466,677 | A | 11/1995 | Baxter et al. |
| 5,466,786 | A | 11/1995 | Buhr et al. |
| 5,470,967 | A | 11/1995 | Huie et al. |
| 5,476,925 | A | 12/1995 | Letsinger et al. |
| 5,484,908 | A | 1/1996 | Froehler et al. |
| 5,486,603 | A | 1/1996 | Buhr |
| 5,489,677 | A | 2/1996 | Sanghvi et al. |
| 5,502,177 | A | 3/1996 | Matteucci et al. |
| 5,510,475 | A | 4/1996 | Agrawal et al. |
| 5,512,439 | A | 4/1996 | Hornes et al. |
| 5,512,667 | A | 4/1996 | Reed et al. |
| 5,514,785 | A | 5/1996 | Van Ness et al. |
| 5,519,126 | A | 5/1996 | Hecht |
| 5,519,134 | A | 5/1996 | Acevedo et al. |
| 5,525,465 | A | 6/1996 | Haralambidis et al. |
| 5,525,711 | A | 6/1996 | Hawkins et al. |
| 5,536,821 | A | 7/1996 | Agrawal et al. |
| 5,539,082 | A | 7/1996 | Nielsen et al. |
| 5,541,307 | A | 7/1996 | Cook et al. |
| 5,541,313 | A | 7/1996 | Ruth |
| 5,541,316 | A | 7/1996 | Engelskirchen et al. |
| 5,543,152 | A | 8/1996 | Webb et al. |
| 5,545,730 | A | 8/1996 | Urdea et al. |
| 5,550,111 | A | 8/1996 | Suhadolnik et al. |
| 5,552,538 | A | 9/1996 | Urdea et al. |
| 5,552,540 | A | 9/1996 | Haralambidis |
| 5,561,225 | A | 10/1996 | Maddry et al. |
| 5,563,253 | A | 10/1996 | Agrawal et al. |
| 5,565,552 | A | 10/1996 | Magda et al. |
| 5,567,810 | A | 10/1996 | Weis et al. |
| 5,567,811 | A | 10/1996 | Misiura et al. |
| 5,571,799 | A | 11/1996 | Tkachuk et al. |
| 5,574,142 | A | 11/1996 | Meyer, Jr. et al. |
| 5,576,427 | A | 11/1996 | Cook et al. |
| 5,578,717 | A | 11/1996 | Urdea et al. |
| 5,578,718 | A | 11/1996 | Cook et al. |
| 5,580,731 | A | 12/1996 | Chang et al. |
| 5,585,481 | A | 12/1996 | Arnold, Jr. et al. |
| 5,587,361 | A | 12/1996 | Cook et al. |
| 5,587,371 | A | 12/1996 | Sessler et al. |
| 5,587,469 | A | 12/1996 | Cook et al. |
| 5,591,584 | A | 1/1997 | Chang et al. |
| 5,591,722 | A | 1/1997 | Montgomery et al. |
| 5,594,121 | A | 1/1997 | Froehler et al. |
| 5,595,726 | A | 1/1997 | Magda et al. |
| 5,596,086 | A | 1/1997 | Matteucci et al. |
| 5,596,091 | A | 1/1997 | Switzer |
| 5,597,696 | A | 1/1997 | Linn et al. |
| 5,597,909 | A | 1/1997 | Urdea et al. |
| 5,599,923 | A | 2/1997 | Sessler et al. |
| 5,599,928 | A | 2/1997 | Hemmi et al. |
| 5,602,240 | A | 2/1997 | De et al. |
| 5,608,046 | A | 3/1997 | Cook et al. |
| 5,610,289 | A | 3/1997 | Cook et al. |
| 5,610,300 | A | 3/1997 | Altmann et al. |
| 5,614,617 | A | 3/1997 | Cook et al. |
| 5,618,704 | A | 4/1997 | Sanghvi et al. |
| 5,623,070 | A | 4/1997 | Cook et al. |
| 5,625,050 | A | 4/1997 | Beaton et al. |
| 5,627,053 | A | 5/1997 | Usman et al. |
| 5,633,360 | A | 5/1997 | Bischofberger et al. |
| 5,639,873 | A | 6/1997 | Barascut et al. |
| 5,646,265 | A | 7/1997 | McGee |
| 5,658,873 | A | 8/1997 | Bertsch-Frank et al. |
| 5,663,312 | A | 9/1997 | Chaturvedula |
| 5,670,633 | A | 9/1997 | Cook et al. |
| 5,677,195 | A | 10/1997 | Winkler et al. |
| 5,677,437 | A | 10/1997 | Teng et al. |
| 5,677,439 | A | 10/1997 | Weis et al. |
| 5,681,941 | A | 10/1997 | Cook et al. |
| 5,688,941 | A | 11/1997 | Cook et al. |
| 5,700,920 | A | 12/1997 | Altmann et al. |
| 5,714,331 | A | 2/1998 | Buchardt et al. |
| 5,719,262 | A | 2/1998 | Buchardt et al. |
| 5,744,305 | A | 4/1998 | Fodor et al. |
| 5,750,692 | A | 5/1998 | Cook et al. |
| 5,770,722 | A | 6/1998 | Lockhart et al. |
| 5,854,033 | A | 12/1998 | Lizardi |
| 5,874,219 | A | 2/1999 | Rava et al. |
| 5,976,567 | A | 11/1999 | Wheeler et al. |
| 5,981,501 | A | 11/1999 | Wheeler et al. |
| 6,015,886 | A | 1/2000 | Dale et al. |
| 6,028,188 | A | 2/2000 | Arnold, Jr. et al. |
| 6,124,445 | A | 9/2000 | Imbach et al. |
| 6,147,200 | A | 11/2000 | Manoharan et al. |
| 6,160,109 | A | 12/2000 | Just et al. |
| 6,166,197 | A | 12/2000 | Cook et al. |
| 6,169,170 | B1 | 1/2001 | Gryaznov et al. |
| 6,172,209 | B1 | 1/2001 | Manoharan et al. |
| 6,222,025 | B1 | 4/2001 | Cook et al. |
| 6,235,887 | B1 | 5/2001 | Froehler et al. |
| 6,239,265 | B1 | 5/2001 | Cook |
| 6,268,490 | B1 | 7/2001 | Imanishi et al. |
| 6,277,603 | B1 | 8/2001 | Cook |
| 6,294,664 | B1 | 9/2001 | Ravikumar et al. |
| 6,320,017 | B1 | 11/2001 | Ansell |
| 6,326,199 | B1 | 12/2001 | Cook et al. |
| 6,346,614 | B1 | 2/2002 | Metelev et al. |
| 6,380,368 | B1 | 4/2002 | Froehler et al. |
| 6,444,423 | B1 | 9/2002 | Meade et al. |
| 6,525,191 | B1 | 2/2003 | Ramasamy |
| 6,528,640 | B1 | 3/2003 | Beigelman et al. |
| 6,531,590 | B1 | 3/2003 | Manoharan et al. |
| 6,534,484 | B1 | 3/2003 | Wheeler et al. |
| 6,534,639 | B1 | 3/2003 | Manoharan et al. |
| 6,576,752 | B1 | 6/2003 | Manoharan et al. |
| 6,586,410 | B1 | 7/2003 | Wheeler et al. |
| 6,608,035 | B1 | 8/2003 | Agrawal et al. |
| 6,617,438 | B1 | 9/2003 | Beigelman et al. |
| 6,639,062 | B2 | 10/2003 | Manoharan et al. |
| 6,670,461 | B1 | 12/2003 | Wengel et al. |
| 6,683,167 | B2 | 1/2004 | Metelev et al. |

(56) References Cited

U.S. PATENT DOCUMENTS

| | | | |
|---|---|---|---|
| 6,770,748 | B2 | 8/2004 | Imanishi et al. |
| 6,783,931 | B1 | 8/2004 | Cook et al. |
| 6,794,499 | B2 | 9/2004 | Wengel et al. |
| 6,815,432 | B2 | 11/2004 | Wheeler et al. |
| 6,858,225 | B2 | 2/2005 | Semple et al. |
| 6,858,715 | B2 | 2/2005 | Ravikumar et al. |
| 6,867,294 | B1 | 3/2005 | Sanghvi et al. |
| 6,878,805 | B2 | 4/2005 | Manoharan et al. |
| 6,900,297 | B1 | 5/2005 | Cook et al. |
| 6,998,484 | B2 | 2/2006 | Koch et al. |
| 7,015,315 | B1 | 3/2006 | Cook et al. |
| 7,034,133 | B2 | 4/2006 | Wengel et al. |
| 7,037,646 | B1 | 5/2006 | Cook et al. |
| 7,041,816 | B2 | 5/2006 | Ravikumar et al. |
| 7,045,610 | B2 | 5/2006 | Dempcy et al. |
| 7,053,207 | B2 | 5/2006 | Wengel |
| 7,084,125 | B2 | 8/2006 | Wengel |
| RE39,464 | E | 1/2007 | Cook et al. |
| 7,273,933 | B1 | 9/2007 | Krotz et al. |
| 7,321,029 | B2 | 1/2008 | Gryaznov et al. |
| 7,399,845 | B2 | 7/2008 | Swayze et al. |
| 7,427,605 | B2 | 9/2008 | Davis et al. |
| 7,427,672 | B2 | 9/2008 | Imanishi et al. |
| 7,495,088 | B1 | 2/2009 | Brakel et al. |
| 7,569,686 | B1 | 8/2009 | Bhat et al. |
| 7,741,457 | B2 | 6/2010 | Seth et al. |
| 8,022,193 | B2 | 9/2011 | Seth et al. |
| 8,030,467 | B2 | 10/2011 | Seth et al. |
| 8,058,069 | B2 | 11/2011 | Yaworski et al. |
| 8,106,022 | B2 | 1/2012 | Manoharan et al. |
| 8,278,283 | B2 | 10/2012 | Seth et al. |
| 8,278,425 | B2 | 10/2012 | Prakash et al. |
| 8,278,426 | B2 | 10/2012 | Seth et al. |
| 8,314,227 | B2 | 11/2012 | Wengel |
| 9,006,198 | B2 | 4/2015 | Bennett et al. |
| 2002/0068709 | A1 | 6/2002 | Orum et al. |
| 2004/0171570 | A1 | 9/2004 | Allerson et al. |
| 2006/0058255 | A1 | 3/2006 | Chen et al. |
| 2008/0039618 | A1 | 2/2008 | Allerson et al. |
| 2009/0012281 | A1 | 1/2009 | Swayze et al. |
| 2010/0324120 | A1 | 12/2010 | Chen et al. |
| 2011/0313020 | A1 | 12/2011 | Templin et al. |
| 2012/0157511 | A1 | 6/2012 | Manoharan et al. |
| 2013/0011922 | A1 | 1/2013 | Quay et al. |
| 2013/0096289 | A1 | 4/2013 | Wengel |
| 2013/0190383 | A1 | 7/2013 | Vaish et al. |
| 2013/0317086 | A1 | 11/2013 | Guire et al. |
| 2014/0135376 | A1 | 5/2014 | Engbersen et al. |
| 2014/0342003 | A1 | 11/2014 | Saltzman et al. |
| 2015/0174549 | A1 | 6/2015 | Lim et al. |
| 2015/0307554 | A1 | 10/2015 | Castillo Rodriguez |
| 2015/0335764 | A1 | 11/2015 | Martinez Fong |
| 2016/0230189 | A1 | 8/2016 | Kotha et al. |
| 2016/0251478 | A1 | 9/2016 | Saltzman et al. |
| 2016/0279256 | A1 | 9/2016 | Wang et al. |
| 2016/0369269 | A1 | 12/2016 | Shen et al. |
| 2017/0044539 | A1 | 2/2017 | Oestergaard et al. |
| 2017/0121454 | A1 | 5/2017 | Saltzman et al. |
| 2017/0182082 | A1* | 6/2017 | Swayze .............. A61K 31/7125 |
| 2017/0183655 | A1* | 6/2017 | Grabczyk ............ C12N 15/113 |
| 2018/0009866 | A1 | 1/2018 | Hoge et al. |
| 2018/0216108 | A1 | 8/2018 | Vargeese et al. |
| 2018/0305689 | A1 | 10/2018 | Saetrom et al. |

FOREIGN PATENT DOCUMENTS

| | | | |
|---|---|---|---|
| WO | WO-9324640 | A2 | 12/1993 |
| WO | WO-9400569 | A1 | 1/1994 |
| WO | WO-9402595 | A1 | 2/1994 |
| WO | WO-9637194 | A1 | 11/1996 |
| WO | WO-9640964 | A2 | 12/1996 |
| WO | WO-9713499 | A1 | 4/1997 |
| WO | WO-9839359 | A1 | 9/1998 |
| WO | WO-9914226 | A2 | 3/1999 |
| WO | WO-0003683 | A2 | 1/2000 |
| WO | WO-0123613 | A1 | 4/2001 |
| WO | WO-2004094636 | A1 | 11/2004 |
| WO | WO-2008042973 | A2 | 4/2008 |
| WO | WO-2008157747 | A1 | 12/2008 |
| WO | WO-2011005861 | A1 | 1/2011 |
| WO | WO-2012177906 | A1 | 12/2012 |
| WO | WO-2013036868 | A1 | 3/2013 |
| WO | WO-2014076195 | A1 | 5/2014 |
| WO | WO-2014179620 | A1 | 11/2014 |
| WO | WO-2014179627 | A2 | 11/2014 |
| WO | WO-2016161380 | A1 | 10/2016 |
| WO | WO-2016170348 | A2 | 10/2016 |
| WO | WO-2017192679 | A1 | 11/2017 |
| WO | WO-2018195165 | A1 | 10/2018 |
| WO | WO-2020117706 | A1 | 6/2020 |

OTHER PUBLICATIONS

GPP Web Portal, shRNA clone IDs: TRCN0000038737, TRCN0000038736, TRCN0000038738, and TRCN0000038735, accessed Jul. 26, 2024 (Year: 2018).*

Aartsma-Rus, 2009, "Guidelines for Antisense Oligonucleotide Design and Insight Into Splice-modulating Mechanisms" The American Society of Gene Therapy, 17(3), p. 548-553 (Year: 2009).*

Reference Sequence NM_001040108.1; *Homo sapiens* mutL homolog 3 (MLH3), transcript variant 1, mRNA, Feb. 5, 2018, accessed Jul. 26, 2024 (Year: 2018).*

Pinto et al., Oct. 2013, "Mismatch Repair Genes Mlh1 and Mlh3 Modify CAG Instability in Huntington's Disease Mice: Genome-Wide and Candidate Approaches" PLOS Genetics, 9(10), e1003930 (Year: 2013).*

Vickers et al., 2001, "Fully modified 2' MOE oligonucleotides redirect polyadenylation", Nucleic Acids Research, vol. 29, No. 6, p. 1293-1299 (Year: 2001).*

Zamaratski et al., 2001, "A critical survey of the structure-function of the antisense oligorRNA heteroduplex as substrate for RNase H", J. Biochem. Biophys. Methods, 48 (2001), p. 189-208 (Year: 2001).*

Lima et al., 2007, Molecular Pharmacology, vol. 71, No. 1 p. 83-91 (Year: 2007).*

Monia et al., 1993, The Journal of Biological Chemistry, vol. 268, No. 19, p. 14514-14522 (Year: 1993).*

Akhtar, S., and Juliano, R. L., "Cellular uptake and intracellular fate of antisense oligonucleotides," Trends in Cell Biology 2(5):139-144, Elsevier Science Publishers Ltd., United Kingdom (May 1992).

Allen, T. M., and Chonn, A., "Large unilamellar liposomes with low uptake into the reticuloendothelial system," FEBS Letters 223(1):42-46, John Wiley & Sons Ltd., United Kingdom (Oct. 1987).

Al-Mahdawi, S., et al., "GAA repeat expansion mutation mouse models of Friedreich ataxia exhibit oxidative stress leading to progressive neuronal and cardiac pathology," Genomics 88(5):580-590, Academic Press, United States (Nov. 2006).

Arnold, A. S., et al., "Specific betal-adrenergic receptor silencing with small interfering RNA lowers high blood pressure and improves cardiac function in myocardial ischemia," Journal of Hypertension 25(1):197-205, Lippincott Williams & Wilkins, United Kingdom (Jan. 2007).

Bangham, A. D., et al., "Diffusion of univalent ions across the lamellae of swollen phospholipids," Journal of Molecular Biology 13(1):238-252, Elsevier, Netherlands (1965).

Barany, F., "Genetic disease detection and DNA amplification using cloned thermostable ligase," Proc Natl Acad Sci USA 88(1):189-193, National Academy of Sciences, United States (Jan. 1991).

Berge, S. M., et al., "Pharmaceutical salts," Journal of Pharmaceutical Sciences 66(1):1-19, John Wiley & Sons, United States (Jan. 1977).

Bergstrom, D. E., "Unnatural nucleosides with unusual base pairing properties," Current Protocols in Nucleic Acid Chemistry 37(1):1.4.1-1.4.32, Wiley Interscience, United States (Jun. 2009).

Bettencourt, C., et al., "DNA repair pathways underlie a common genetic mechanism modulating onset in polyglutamine diseases," Annals of Neurology 79(6):983-990, Wiley Periodicals, United States (Jun. 2016).

(56) References Cited

OTHER PUBLICATIONS

Black, R. D., and Sang, C. N., "Advances and limitations in the evaluation of analgesic combination therapy," Neurology 65(12 Suppl 4): S3-S6, Lippincott Williams & Wilkins, United States (Dec. 2005).
Bonnet, M. E., et al., "Systemic delivery of DNA or siRNA mediated by linear polyethylenimine (L-PEI) does not induce an inflammatory response," Pharmaceutical Research 25(12):2972-2982, Kluwer Academic/Plenum Publishers, United States (Dec. 2008).
Bourn, R. L., et al., "Pms2 suppresses large expansions of the (GAA•TTC)$_n$ sequence in neuronal tissues," PLoS One 7(10):e47085, Public Library of Science, United States (2012).
Carroll, J. B., et al., "Potent and selective antisense oligonucleotides targeting single-nucleotide polymorphisms in the Huntington disease gene / allele-specific silencing of mutant huntingtin," Molecular Therapy 19(12):2178-2185, Cell Press, United States (Dec. 2011).
Chatterjee, N., et al., "Mismatch repair enhances convergent transcription-induced cell death at trinucleotide repeats by activating ATR," DNA Repair 42:26-32, Elsevier, Netherlands. (Jun. 2016).
Chien, P., et al., "Novel cationic cardiolipin analogue-based liposome for efficient DNA and small interfering RNA delivery in vitro and in vivo," Cancer Gene Therapy 12(3):321-328, Nature Publishing Group, United Kingdom (Mar. 2005).
Coppede, F., et al., "The hOGGl Ser326Cys polymorphism and Huntington's disease," Toxicology 278(2):199-203, Elsevier, Ireland (Dec. 2010).
Crooke, S. T., et al., "Pharmacokinetic properties of several novel oligonucleotide analogs in mice," The Journal of Pharmacology and Experimental Therapeutics 277(2):923-937, American Society for Pharmacology and Experimental Therapeutics, United States (May 1996).
Drouet, V., et al., "Allele-specific silencing of mutant huntingtin in rodent brain and human stem cells," PLoS One 9(6):e99341, Public Library of Science, United States (Jun. 2014).
Du Plessis, J., et al., "Topical delivery of liposomally encapsulated gamma-interferon," Antiviral Research 18(3-4):259-265, Elsevier, Netherlands (Jun. 1992).
Englisch, U., and Gauss, D. H., "Chemically Modified Oligonucleotides as Probes and Inhibitors," Angewandte Chemie International Edition 30(6):613-629, Germany Chemical Society, Germany (1991).
Feigner, J. H., et al., "Enhanced gene delivery and mechanism studies with a novel series of cationic lipid formulations," The Journal of Biological Chemistry 269(4):2550-2561, Elsevier Inc., United States (Jan. 1994).
Feigner, P. L., et al., "Lipofection: a highly efficient, lipid-mediated DNA-transfection procedure," Proc Natl Acad Sci USA 84(21):7413-7417, National Academy of Sciences, United States (Nov. 1987).
Fluiter, K., et al., "Filling the gap in LNA antisense oligo gapmers: the effects of unlocked nucleic acid (UNA) and 4'-C-hydroxymethyl-DNA modifications on RNase H recruitment and efficacy of an LNA gapmer," Molecular BioSystems 5(8):838-843, Royal Society of Chemistry, United Kingdom (Aug. 2009).
Fukunaga, M., et al., "Liposome entrapment enhances the hypocalcemic action of parenterally administered calcitonin, " Endocrinology 115(2):757-761, Oxford University Press, United Kingdom (Aug. 1984).
Gabizon, A., and Papahadjopoulos, D., "Liposome formulations with prolonged circulation time in blood and enhanced uptake by tumors," Proc Natl Acad Sci USA 85(18):6949-6953, National Academy of Sciences, United States (Sep. 1988).
Gao, X., and Huang, L., "A novel cationic liposome reagent for efficient transfection of mammalian cells," Biochemical and Biophysical Research Communications 179(1):280-285, Elsevier, United States (Aug. 1991).
Geary, R. S., et al., "Absolute bioavailability of 2'-O-(2-methoxyethyl)-modified antisense oligonucleotides following intraduodenal instillation in rats," Journal of Pharmacology and Experimental Therapeutics 296(3):898-904, American Society for Pharmacology and Experimental Therapeutics, United States (Mar. 2001).
Genbank, "*Homo sapiens* mutL homolog 3 (MLH3), transcript variant 1, mRNA," Accession No. NM_001040108.1, accessed at URL:[https://www.ncbi.nlm.nih.gov/nuccore/NM_001040108.1] on Dec. 18, 2024, 6 pages.
Genbank, "Mus musculus mutL homolog 3 (Mlh3), transcript variant 1, mRNA," Accession No. NM_175337.2, accessed at URL:[https://www.ncbi.nlm.nih.gov/nuccore/NM_175337.2] on Dec. 18, 2024, 5 pages.
Genbank, "Predicted: Macaca fascicularis mutL homolog 3 (MLH3), transcript variant X1, mRNA," Accession No. XM_005561790.2, accessed at URL:[https://www.ncbi.nlm.nih.gov/nuccore/XM_005561790.2] on Dec. 18, 2024, 3 pages.
Genbank, "Rattus norvegicus mutL homolog 3 (Mlh3), mRNA," Accession No. NM_001108043.1, accessed at URL:[https://www.ncbi.nlm.nih.gov/nuccore/NM_001108043.1] on Dec. 18, 4 pages.
Genpept, "DNA mismatch repair protein Mlh3 isoform 1 [*Homo sapiens*]," Accession No. NP_001035197.1, accessed at URL:[https://www.ncbi.nlm.nih.gov/protein/NP_001035197.1] on Dec. 18, 2024, 4 pages.
Genetic Modifiers of Huntington's Disease (GeM-HD) Consortium, "Identification of genetic factors that modify clinical onset of Huntington's disease," Cell 162(3):516-526, Cell Press, United States (Jul. 2015).
Gershon, H., et al., "Mode of formation and structural features of DNA-cationic liposome complexes used for transfection," Biochemistry 32(28):7143-7151, American Chemical Society, United States (Jul. 1993).
Gomes-Pereira, M., and Monckton, D. G., "Ethidium bromide modifies the agarose electrophoretic mobility of CAG.CTG alternative DNA structures generated by PCR," Frontiers in Cellular Neuroscience 11:153, Frontiers Research Foundation, Switzerland (May 2017).
Goold, R., et al., "FAN1 modifies Huntington's disease progression by stabilizing the expanded HTT CAG repeat," Human Molecular Genetics 28(4):650-661, Oxford University Press, United Kingdom (Feb. 2019).
Grunweller, A., et al., "Comparison of different antisense strategies in mammalian cells using locked nucleic acids, 2'-O-methyl RNA, phosphorothioates and small interfering RNA," Nucleic Acids Research 31(12):3185-3193, Oxford University Press, United Kingdom (Jun. 2003).
Guatelli, J. C., et al., "Isothermal, in vitro amplification of nucleic acids by a multienzyme reaction modeled after retroviral replication," Proc Natl Acad Sci USA 87(5):1874-1878, National Academy of Sciences, United States (Mar. 1990).
Halabi, A., et al., "DNA mismatch repair complex MutSB promotes GAA•TTC repeat expansion in human cells," The Journal of Biological Chemistry 287(35):29958-29967, Elsevier Inc., United States (Aug. 2012).
Hirao, I., et al., "Natural versus artificial creation of base pairs in DNA: origin of nucleobases from the perspectives of unnatural base pair studies," Accounts of Chemical Research 45(12):2055-2065, American Chemical Society, United States (Dec. 2012).
Hu, Z., et al., "Topical delivery of Ciclosporin—A from nonionic liposomal systems: an in vivo/in vitro correlation study using hairless mouse skin," STP Pharma Sci 4(6):466-469, Société Française des Sciences et Techniques Pharmaceutiques, France (1994).
Halabi, A., et al., "GAA+TTC Repeat ExpansionIn Human Cells is Mediated By Mismatch Repair Complex MutLy and Depends Upon the Endonuclease Domain in MLH3 Isoform One," Nucleic Acid Research 46(8):4022-4032, Oxford Academic, United Kingdom (2018).
International Search Report and Written Opinion for International Application No. PCT/US2019/064059, ISA/US, Commissioner for Patents, Virginia, mailed on Mar. 3, 2020, 10 pages.
Itani, T., et al., "A simple and efficient liposome method for transfection of DNA into mammalian cells grown in suspension," Gene 56(2-3):267-276, Elsevier, Netherlands (1987).

(56) References Cited

OTHER PUBLICATIONS

Jensen, T. B., et al., "Unlocked nucleic acid (UNA) and UNA derivatives: thermal denaturation studies," Nucleic Acids Symposium Series No. 52:133-134, 2008 Oxford University Press, United Kingdom (Sep. 2008).
Kabanov, A. V., et al., "A new class of antivirals: antisense oligonucleotides combined with a hydrophobic substituent effectively inhibit influenza virus reproduction and synthesis of virus-specific proteins in MDCK cells," FEBS letters 259(2):327-330, John Wiley & Sons Ltd, United Kingdom (1990).
Kalota, A., et al., "2'-deoxy-2'-fluoro-beta-D-arabinonucleic acid (2'F-ANA) modified oligonucleotides (ON) effect highly efficient, and persistent, gene silencing," Nucleic Acids Research 34(2):451-461, Oxford University Press, United Kingdom (Jan. 2006).
Kim, S., et al., "Preparation of multivesicular liposomes," Biochimica Et Biophysica Acta 728(3):339-348, Elsevier, Netherlands (Mar. 1983).
Kovtun, I. V., et al., "OGGI initiates age-dependent CAG trinucleotide expansion in somatic cells," Nature 447(7143):447-452, Nature Publishing Group, United Kingdom (May 2007).
Kubo, T., et al., "Chemically modified symmetric and asymmetric duplex RNAs: an enhanced stability to nuclease degradation and gene silencing effect," Biochemical and Biophysical Research Communications 365(1):54-61, Elsevier, United States (Jan. 2008).
Kwoh, D. Y., et al., "Transcription-based amplification system and detection of amplified human immunodeficiency virus type 1 with a bead-based sandwich hybridization format," Proc Natl Acad Sci USA 86(4):1173-1177, National Academy of Sciences, United States (1989).
Lam, K. S., et al., "A new type of synthetic peptide library for identifying ligand-binding activity," Nature 354:82-84, Nature Publishing Group, United States (1991).
Larson, E., et al., "Age-, tissue- and length-dependent bidirectional somatic CAG•CTG repeat instability in an allelic series of R6/2 Huntington disease mice," Neurobiology of Disease 76:98-111, Academic Press, United States (Apr. 2015).
Lee, J. M., et al., "A novel approach to investigate tissue-specific trinucleotide repeat instability," BMC Systems Biology 4:29, BioMed Central, United Kingdom (Mar. 2010).
Letsinger, R. L., et al., "Cholesteryl-conjugated oligonucleotides: synthesis, properties, and activity as inhibitors of replication of human immunodeficiency virus in cell culture," Proc Natl Acad Sci USA 86(17):6553-6556, National Academy of Science, United States (Sep. 1989).
Li, Y., et al., "Establishment and maintenance of primary fibroblast repositories for rare diseases-friedreich's ataxia example," Biopreservation and Biobanking 14(4):324-329, Mary Ann Liebert Inc., United States (Aug. 2016).
Liu, S., "Radiolabeled multimeric cyclic RGD peptides as integrin alpha,beta3 targeted radiotracers for tumor imaging," Molecular Pharmaceutics 3(5):472-487, American Chemical Society, United States (Sep.-Oct. 2006).
Lizardi, P. M., et al., "Exponential amplification of recombinant—RNA hybridization probes," Nature Biotechnology 6:1197-1202, Nature Publishing Group, United Kingdom (Oct. 1988).
Long, J. D., et al., "Genetic modification of Huntington disease acts early in the prediagnosis phase," American Journal of Human Genetics 103(3):349-357, 9 pages, Elsevier, Netherlands (Sep. 2018).
Mangiarini, L., et al., "Exon 1 of the HD gene with an expanded CAG repeat is sufficient to cause a progressive neurological phenotype in transgenic mice," Cell 87(3):493-506, Cell Press, United States (Nov. 1996).
Mangiarini, L., et al., "Instability of highly expanded CAG repeats in mice transgenic for the Huntington's disease mutation," Nature Genetics 15(2):197-200, Nature Publishing Group, United Kingdom (Feb. 1997).
Mannino R. J., and Gould-Fogerite, S., "Liposome mediated gene transfer," BioTechniques, 6(7):682-690, Future Science, United Kingdom (Jul.-Aug. 1988).
Manoharan, M., et al., "Chemical modifications to improve uptake and bioavailability of antisense oligonucleotides," Annals of the New York Academy of Sciences 660:306-309, Blackwell, United States (Oct. 1992).
Manoharan, M., et al., "Cholic acid oligonucliotide conjugates for antisense applications," Bioorganic & Medicinal Chemistry Letters 4(8):1053-1060, Elsevier, United States (1994).
Manoharan, M., et al., "Introduction of a lipophilic thioether tether in the minor groove of nucleic acids for antisense applications," Bioorganic & Medicinal Chemistry Letters 3(12):2765-2770, Elsevier, United States (Dec. 1993).
Manoharan, M., et al., "Oligonucleotide conjugates: alteration of the pharmacokinetic properties of antisense agents," Nucleosides and Nucleotides 14:969-973, M. Dekker, United States (1995).
Manoharan, M., et al., "Lipidic nucleic acids," Tetrahedron Letters 36:3651-3654, Elsevier, United Kingdom (1995).
Martin, P., "A new access to 2'-O-alkylated ribonucleosides and properties of 2'-O-alkylated oligoribonucleotides," Helvetica Chimica Acta 78(2):486-504, John Wiley & Sons, Switzerland (Jan. 1995).
Mayer, L. D., et al., "Vesicles of variable sizes produced by a rapid extrusion procedure," Biochim Biophys Acta 858(1):161-168, Elsevier, Netherlands (Jun. 1986).
Mayhew, E., et al., "Characterization of liposomes prepared using a microemulsifier," Biochim Biophys Acta 775(2):169-174, Elsevier, Netherlands (Aug. 1984).
Min, K-L., et al., "Oligonucleotides comprised of alternating 2'-deoxy-2'-fluoro-beta-D-arabinonucleosides and D-2'-deoxyribonucleosides (2'F-ANA/DNA 'altimers') induce efficient RNA cleavage mediated by RNase H," Bioorganic & Medicinal Chemistry Letters 12(18):2651-2654, Elsevier Science Ltd., United Kingdom (Sep. 2002).
Mishra, R. K., et al., "Improved leishmanicidal effect of phosphorotioate antisense oligonucleotides by LDL-mediated delivery," Biochimica et Biophysica Acta 1264(2):229-237, Elsevier, Netherlands (1995).
Morales, F., et al., "A polymorphism in the MSH3 mismatch repair gene is associated with the levels of somatic instability of the expanded CTG repeat in the blood DNA of myotonic dystrophy type 1 patients," DNA Repair 40:57-66, Elsevier, Netherlands (Apr. 2016).
Mullis, K. B., and Faloona, F. A., "Specific synthesis of DNA in vitro via a polymerase- catalyzed chain reaction," Methods in Enzymology, 155:335-350, Academic Press, United States (1987).
Nabel, E. G., et al., "Gene transfer in vivo with DNA-liposome complexes: lack of autoimmunity and gonadal localization," Human Gene Therapy 3(6):649-656, Mary Ann Liebert Inc., United States (Dec. 1992).
Nabel, G. J., et al., "Direct gene transfer with DNA-liposome complexes in melanoma: expression, biologic activity, and lack of toxicity in humans," Proc Natl Acad Sci USA 90(23):11307-11311, National Academy of Sciences, United States (Dec. 1993).
Nicolau, C., et al., "Liposomes as carriers for in vivo gene transfer and expression," Methods in Enzymology 149:157-176, Academic Press, United States (1987).
Nielsen, P. E., et al., "Sequence-selective recognition of DNA by strand displacement with a thymine-substituted polyamide," Science 254(5037):1497-1500, American Association for the Advancement of Science, United States (Dec. 1991).
Oberhauser, B., and Wagner, E., "Effective incorporation of 2'-O-methyl-oligoribonucleotides into liposomes and enhanced cell association through modification with thiocholesterol," Nucleic Acids Research 20(3):533-538, Oxford University Press, United Kingdom (1992).
Olson, F., et al., "Preparation of liposomes of defined size distribution by extrusion through polycarbonate membranes," Biochimica Et Biophysica Acta 557(1):9-23, Elsevier, Netherlands (Oct. 1979).
Pal, A., et al., "Systemic delivery of RafsiRNA using cationic cardiolipin liposomes silences Raf-1 expression and inhibits tumor growth in xenograft model of human prostate cancer," International Journal of Oncology 26(4):1087-1091, Spandidos, Greece (Apr. 2005).
Pandey, S.K., et al., "Identification and characterization of modified antisense oligonucleotides targeting DMPK in mice and nonhuman primates for the treatment of myotonic dystrophy type 1," J Phar-

(56) References Cited

OTHER PUBLICATIONS macology and Experimental Therapeutics 355(2):329-340, American Society for Pharmacology and Experimental Therapeutics, United States (Nov. 2015).
Papahadjopoulos, D and Gabizon, A., "Targeting of liposomes to tumor cells in vivo," Annals of the New York Academy of Sciences 507:64-74, Blackwell, United States (1987).
Pinto, R. M., et al., "Mismatch repair genes Mlh1 and Mlh3 modify CAG instability in Huntington's disease mice: genome-wide and candidate approaches," PLoS Genetics 9(10):e1003930, Public Library of Science, United States (Oct. 2013).
Pouladi, M.A., et al., "Choosing an animal model for the study of Huntington's disease," Nature Reviews. Neuroscience 14(10):708-721, Nature Publishing Group, United Kingdom (Oct. 2013).
Saison-Behmoaras, T., et al., "Short modified antisense oligonucleotides directed against Ha-ras point mutation induce selective cleavage of the mRNA and inhibit T24 cells proliferation," The EMBO Journal 10(5):1111-1118, Wiley Blackwell, United Kingdom (1991).
Shea, R. G., et al., "Synthesis, hybridization properties and antiviral activity of lipid-oligodeoxynucleotide conjugates," Nucleic Acids Research 18(13):3777-3783, Oxford University Press, United Kingdom (1990).
Simeoni, F., et al., "Insight into the mechanism of the peptide-based gene delivery system MPG: implications for delivery of siRNA into mammalian cells," Nucleic Acids Research 31(11):2717-2724, Oxford University Press, United Kingdom (Jun. 2003).
Skotte, N. H., et al., "Allele-specific suppression of mutant huntingtin using antisense oligonucleotides: providing a therapeutic option for all Huntington disease patients," PLoS One 9(9):e107434, Public Library of Science, United States (Sep. 2014).
Sorensen, D. R., et al., "Gene silencing by systemic delivery of synthetic siRNAs in adult mice," Journal of Molecular Biology 327(4):761-766, Elsevier, United Kingdom (Apr. 2003).
Straubinger, R. M., and Papahadjopoulos, D., "Liposomes as carriers for intracellular delivery of nucleic acids," Methods in Enzymology 101:512-527, Academic Press, United States (1983).
Strauss, W. M., and Jaenisch, R., "Molecular complementation of a collagen mutation in mammalian cells using yeast artificial chromosomes," The EMBO Journal 11(2):417-422, Wiley Blackwell, United Kingdom (Feb. 1992).
Summerton, J., et al., "Morpholino and phosphorothioate antisense oligomers compared in cell-free and in-cell systems," Antisense and Nucleic Acid Drug Development 7(2):63-70, Mary Ann Liebert Inc., United States (Apr. 1997).
Svinarchuk, F. P., et al., "Inhibition of HIV proliferation in MT-4 cells by antisense oligonucleotide conjugated to lipophilic groups," Biochimie 75(1-2):49-54, Elsevier, France (1993).
Szoka Jr., F. S., and Papahadjopoulos, D., "Procedure for preparation of liposomes with large internal aqueous space and high capture by reverse-phase evaporation," Proc Natl Acad Sci USA 75(9):4194-4198, National Academy of Sciences, United States (Sep. 1978).
Tomalia, D. A., et al., "Dendrimers as multi-purpose nanodevices for oncology drug delivery and diagnostic imaging," Biochemical Society Transactions 35(Pt 1):61-67, Portland Press, United Kingdom (Feb. 2007).
Tome, S., et al., "MSH2 ATPase domain mutation affects CTG*CAG repeat instability in transgenic mice," PLoS Genetics 5(5):e1000482, Public Library of Science, United States (May 2009).
Verma, U. N., et al., "Small interfering RNAs directed against beta-catenin inhibit the in vitro and in vivo growth of colon cancer cells," Clinical Cancer Research 9(4):1291-1300, American Association for Cancer Research, United States (Apr. 2003).
Wang, C. Y., and Huang, L., "Plasmid DNA adsorbed to pH-sensitive liposomes efficiently transforms the target cells," Biochemical and Biophysical Research Communications 147(3):980-985, Elsevier, United States (Sep. 1987).
Wang, C. Y., and Huang, L., "pH-sensitive immunoliposomes mediate target-cell-specific delivery and controlled expression of a foreign gene in mouse," Proc Natl Acad Sci USA 84(22):7851-7855, National Academy of Sciences, United States (Nov. 1987).
Warby, S. C., et al., "CAG expansion in the Huntington disease gene is associated with a specific and targetable predisposing haplogroup," American Journal of Human Genetics 84(3):351-366, Cell Press, United States (Mar. 2009).
Weiner, N., et al., "Liposomes: a novel topical delivery system for pharmaceutical and cosmetic applications," Journal of Drug Targeting 2(5):405-410, Harwood Academic Publishers GmbH, United States (1994).
Wheeler, V. C., et al., "Length-dependent gametic CAG repeat instability in the Huntington's disease knock-in mouse," Human Molecular Genetics 8(1):115-122, Oxford University Press, United Kingdom (Jan. 1999).
Wheeler, V. C., et al., "Long glutamine tracts cause nuclear localization of a novel form of huntingtin in medium spiny striatal neurons in $Hdh^{Q92}$ and $Hdh^{Q111}$ knock-in mice," Human Molecular Genetics 9(4):503-513, Oxford University Press, United Kingdom (Mar. 2000).
Wu, N. Z., et al., "Increased microvascular permeability contributes to preferential accumulation of Stealth liposomes in tumor tissue," Cancer Research 53(16):3765-3670, American Association for Cancer Research, United States (Aug. 1993).
Xu, Z. Z., and Mathews, D. H., "Secondary Structure Prediction of Single Sequences Using RNAstructure," Methods in Molecular Biology 1490:15-34, Humana Press, United States (2016).
Yoo, H., et al., "PAMAM dendrimers as delivery agents for antisense oligonucleotides," Pharmaceutical Research 16(12):1799-1804, Kluwer Academic/Plenum Publishers, United States (Dec. 1999).
Zhang, W., et al., "Treatment of type 1 myotonic dystrophy by engineering site-specific RNA endonucleases that target (CUG)(n) repeats," Molecular Therapy 22(2):312-320, Cell Press, United States (Feb. 2014).
Zhou, X., et al., "Lipophilic polylysines mediate efficient DNA transfection in mammalian cells," Biochim Biophys Acta 1065(1):8-14, Elsevier, Netherlands (May 1991).
Zhou, X., and Huang, L., "Targeted delivery of DNA by liposomes and polymers," Journal of Controlled Release 19:269-274, Elsevier Science Publishers, United States (1992).
Zhou, C., et al., "Fine tuning of electrostatics around the internucleotidic phosphate through incorporation of modified 2',4'-carbocyclic-LNAs and -ENAs leads to significant modulation of antisense properties," The Journal of Organic Chemistry 74(1):118-134, American Chemical Society, United States (Jan. 2009).
Zimmermann, T. S., et al., "RNAi-mediated gene silencing in non-human primates," Nature 441(7089):111-114, Nature Publishing Group, United Kingdom (Mar. 2006).
Aigner, A., "Delivery Systems for the Direct Application of siRNAs toInduce RNA Interference (RNAi) In Vivo," Journal of Biomedicine and Biotechnology, 2006, 71659, pp. 1-15, Hindawi Publishing Corp. (2006).
Chauhan, D., et al., "Antisense Inhibition of Hmlh1 is Not Sufficient For Loss of DNA Mismatch Repair Function in the HCT116+ Chromosome 3 Cell Line," Clinical Cancer Research 6:3827-3831, American Cancer Research, United States (2000).
Tome, S., et al., "MSH3 Polymorphisms and Protein Levels Affect CAG Repeat Instability in Huntington's Disease Mice," Plos Genetics 9(2):e1003280, Public Library of Science, United States (2013).
Sanghvi, Y. S., Crooke, S. T., and Lebleu, B., "Chapter 15—Heterocyclic Base Modifications in Nucleic acids and their Applications in Antisense Oligonucleotides," in *Antisense Research and Applications*, pp. 273-288, CRC Press, United States (1993).
Seznec, H., et al., "Transgenic Mice Carrying Large Human Genomic Sequences With Expanded CTG Repeat Mimic Closely the DM CTG Repeat Intergenerational and Somatic Instability," Human Molecular Genetics 9(8):1185-1194, Oxford, United Kingdom (May 2000).

* cited by examiner

METHODS FOR THE TREATMENT OF TRINUCLEOTIDE REPEAT EXPANSION DISORDERS ASSOCIATED WITH MLH3 ACTIVITY

INCORPORATION BY REFERENCE OF SEQUENCE LISTING

The contents of the text file named "2024-06-07-4398_0060003_Seqlisting_ST25 txt" which was created on May 30, 2024 and is 993,791 bytes in size, is hereby incorporated by reference in its entirety.

BACKGROUND

Trinucleotide repeat expansion disorders are genetic disorders caused by trinucleotide repeat expansions. Trinucleotide repeat expansions are a type of genetic mutation where nucleotide repeats in certain genes or introns exceed the normal, stable threshold for that gene. The trinucleotide repeats can result in defective or toxic gene products, impair RNA transcription, and/or cause toxic effects by forming toxic mRNA transcripts.

Trinucleotide repeat expansion disorders are generally categorized by the type of repeat expansion. For example, Type 1 disorders such as Huntington's disease are caused by CAG repeats which result in a series of glutamine residues known as a polyglutamine tract, Type 2 disorders are caused by heterogeneous expansions that are generally small in magnitude, and Type 3 disorders such as fragile X syndrome are characterized by large repeat expansions that are generally located outside of the protein coding region of the genes. Triucleotide repeat expansion disorders are characterized by a wide variety of symptoms such as progressive degeneration of nerve cells that is common in the Type 1 disorders.

Subjects with a trinucleotide repeat expansion disorder or those who are considered at risk for developing a trinucleotide repeat expansion disorder have a constitutive nucleotide expansion in a gene associated with disease (i e., the trinucleotide repeat expansion is present in the gene during embryogenesis). Constitutive trinucleotide repeat expansions can undergo expansion after embryogenesis (i.e., somatic trinucleotide repeat expansion). Both constitutive trinucleotide repeat expansion and somatic trinucleotide repeat expansion can be associated with presence of disease, age at onset of disease, and/or rate of progression of disease.

SUMMARY OF THE DISCLOSURE

The present invention features useful compositions and methods to treat trinucleotide repeat expansion disorders, e.g., in a subject in need thereof. In some aspects, the compositions and methods described herein are useful in the treatment of disorders associated with MLH3 activity.

Ollgonucleoddes

Some aspects of this disclosure are directed to a single-stranded oligonucleotide of 10-30 linked nucleosides in length, wherein the oligonucleotide comprises a region of at least 10 contiguous nucleobases having at least 80% complementary to an MLH3 gene. In some aspects, the oligonucleotide comprises: (a) a DNA core sequence comprising linked deoxyribonucleosides; (b) a 5' flanking sequence comprising linked nucleosides; and (c) a 3' flanking sequence comprising linked nucleosides; wherein the DNA core comprises a region of at least 10 contiguous nucleobases having at least 80% complementarity to an MLH3 gene and is positioned between the 5' flanking sequence and the 3' flanking sequence; wherein the 5' flanking sequence and the 3' flanking sequence each comprises at least two linked nucleosides; and wherein at least one nucleoside of each flanking sequence comprises an alternative nucleoside.

In some aspects, the disclosure is directed to a single-stranded oligonucleotide of 10-30 linked nucleosides in length for inhibiting expression of a human MLH3 gene in a cell, wherein the oligonucleotide comprises a region of at least 10 contiguous nucleobases having at least 80% complementarity to an MLH3 gene. In some aspects, the oligonucleotide comprises: (a) a DNA core comprising linked deoxyribonucleosides; (b) a 5' flanking sequence comprising linked nucleosides; and (c) a 3' flanking sequence comprising linked nucleosides; wherein the DNA core comprises a region of at least 10 contiguous nucleobases having at least 80% complementarity to an MLH3 gene and is positioned between the 5' flanking sequence and the 3' flanking sequence, wherein the 5' flanking sequence and the 3' flanking sequence each comprises at least two linked nucleosides; and wherein at least one nucleoside of each flanking sequence comprises an alternative nucleoside. In some aspects, the region of at least 10 nucleobases has at least 90% complementary to an MLH3 gene. In some aspects, the region of at least 10 nucleobases has at least 95% complementary to an MLH3 gene.

In some aspects, the region of at least 10 nucleobases is complementary to an MLH3 gene corresponding to a sequence of reference mRNA NM_001040108.1 at one or more of positions 221-293, 321-506, 534-576, 584-636, 681-740, 818-878, 952-1024, 1129-1158, 1177-1264, 1287-1318, 1351-1378, 1536-1598, 1623-1660, 1739-1764, 1782-1823, 1847-1908, 2026-2051, 2063-2094, 2115-2146, 2256-2290, 2387-2414, 2421-2592, 2727-2788, 2826-2937, 3005-3043, 3078-3107, 3159-3185, 3214-3239, 3244-3272, 3282-3308, 3426-3483, 3561-3587, 3642-3769, 3804-3839, 3950-3977, 4004-4040, 4052-4115, 4139-4199, 4241-4301, 4328-4365, 4420-4448, 4472-4536, 4669-4708, or 4784-4810 of the MLH3 gene. In some aspects, the region of at least 10 nucleobases is complementary to an MLH3 gene corresponding to a sequence of reference mRNA NM_001040108.1 at one or more of positions 221-293, 321-506, 534-576, 584-636, 681-740, 818-878, 952-1024, 1129-1158, 1177-1264, 1287-1318, 1351-1378, 1568-1598, 1623-1660, 1782-1823, 1870-1904, 2063-2094, 2115-2146, 2256-2287, 2387-2414, 2422-2592, 2727-2788, 2826-2937, 3009-3043, 3078-3107, 3159-3185, 3214-3272, 3282-3307, 3426-3483, 3561-3587, 3642-3767, 3804-3839, 3950-3977, 4004-4039, 4052-4115, 4139-4199, 4241-4301, 4329-4365, 4420-4448, 4472-4536, 4680-4708, or 4784-4810 of the MLH3 gene. In some aspects, the region of at least 10 nucleobases is complementary to an MLH3 gene corresponding to a sequence of reference mRNA NM_001040108.1 at one or more of positions 221-293, 321-506, 534-635, 681-740, 842-875, 953-1024, 1129-1158, 1179-1264, 1287-1316,1351-1378, 1568-1598,1623-1659, 1782-1823, 1870-1904, 2064-2091, 2115-2146, 2256-2287, 2387-2414, 2422-2592, 2727-2788,2829-2937, 3010-3043, 3079-3107, 3159-3185, 3246-3271, 3282-3307, 3426-3474, 3561-3587, 3642-3707, 3804-3839, 3950-3977, 4004-4039, 4052-4114, 4139-4164, 4174-4199, 4241-4288, 4329-4365, 4421-4448, 4472-4536, 4680-4708, or 4784-4810 of the MLH3 gene. In some aspects, the region of at least 10 nucleobases is complementary to an MLH3 gene corresponding to a sequence of reference mRNA NM_001040108.1 at one or more of positions 331-362, 393-438, 479-505, 534-574, 587-612, 681-740, 847-873, 991-1024, 1210-1262, 1351-1378, 1571-1597, 1623-1648, 1874-1902, 2066-2091, 2256-2281, 2388-2414, 2470-2515, 2732-2788, 2853-2878, 2901-2927, 3282-3307, 3562-3587, 4056-4083, 4241-4266, or 4506-4531 of the MLH3 gene. In some aspects, the region of at least 10 nucleobases is complementary to an MLH3 gene corresponding to a sequence of reference mRNA NM_001040108.1 at one or more of positions 335-449, 587-612, 682-736, 848-873, 991-1016, 1179-1204, 1233-1260, 1351-1378, 1626-1651, 1874-1903, 2066-2091, 2115-2146, 2256-2287, 2389-2414, 2471-2499, 2762-2787, 2853-2878, 2911-2936, 3562-3587, 3814-3839, 4006-4031, 4056-4083, or 4244-4269 of the MLH3 gene. In some aspects, the region of at least 10 nucleobases is complementary to an MLH3 gene corresponding to a sequence of reference mRNA NM_001040108.1 at one or more of positions 355-393, 952-984, 1177-1205, 2026-2052, 2066-2094, 2470-2498, 3159-3185, 3458-3485, or 4259-4292 of the MLH3 gene.

In some aspects, the oligonucleotide comprises the nucleobase sequence of any one of SEQ ID NOs: 6-4710. In some aspects, the oligonucleotide comprises the nucleobase sequence of any one of SEQ ID NOs: 89, 92, 102, 107-108, 110-111, 115-116, 150, 154, 160-161, 163-164, 166, 168, 175-176, 178, 180, 182-183, 185-189, 201, 211-212, 229-231, 234-238, 241, 248-250, 254, 265-269, 282-283, 285-288, 294, 296, 319-322, 328-329, 366-368, 377-379, 381-399, 487-488, 511, 514-517, 520, 566-568, 573, 591, 593-594, 599, 602, 666, 669-670, 701-704, 728, 749-753, 755, 757, 784, 786-788, 790, 828-830, 959, 972, 974-977, 1002, 1004-1005, 1007, 1009-1013, 1086, 1110-1111, 1126, 1149, 1172, 1176-1181, 1185, 1260, 1271-1274,1276-1277, 1297, 1302, 1387-1390, 1392-1393, 1396, 1461-1463, 1473-1474, 1482, 1490-1491, 1495, 1498-1502, 1505, 1508, 1510-1514, 1516-1518, 1525-1526, 1529-1530, 1546-1547, 1572, 1596-1597, 1721-1722, 1724-1727, 1744-1746, 1797, 1800-1802, 1824-1826, 1832, 1835-1836, 1859, 1865-1866, 1870-1873, 1875, 1878, 1880-1882, 1911, 1914-1918, 1924, 1945-1946, 1949, 2000-2001, 2035, 2064, 2066-2067, 2090-2091, 2163, 2166, 2169-2172, 2178, 2181, 2184, 2186, 2194, 2255-2256, 2307, 2321, 2333, 2343, 2345-2346, 2353-2355, 2394-2395, 2403-2404, 2460-2462, 2489-2492, 2495, 2499-2500, 2524-2530, 2561-2562, 2591, 2595, 2616, 2644-2651, 2653-2654, 2661-2664, 2674, 2683-2685, 2687, 2690-2691, 2693-2695, 2725-2728, 2777-2782, 2784-2785, 2789, 2791-2792, 2794-2795, 2797, 2848-2852, or 2917-2918. In some aspects, the oligonucleotide comprises the nucleobase sequence of any one of SEQ ID NOs: 89, 92, 102, 107-108, 111, 116, 150, 154, 160-161, 163-164, 166, 168, 175-176, 178, 180, 182-183, 185-189, 201, 211-212, 229-231, 234-236, 238, 241, 248-250, 254, 265-269, 282-283, 285-288, 294, 296, 319-320, 322, 328-329, 366-368, 377, 379, 381-399, 487-488, 511, 514-517, 520, 566-568, 573, 591, 593-594, 599, 602, 666, 669-670, 701-704, 728, 750-753, 755, 757, 784, 786-788, 790, 828-830, 972, 974-977, 1002, 1004-1005, 1009-1013, 1110-1111, 1126, 1172, 1176-1181, 1271-1274, 1276-1277, 1297, 1302, 1387, 1390, 1392-1393, 1461-1463, 1474, 1482, 1490-1491, 1498-1502, 1505, 1508, 1510-1512, 1514, 1516-1518, 1525-1526, 1529-1530, 1546-1547, 1572, 1597, 1721-1722, 1724-1727, 1744-1746, 1797, 1800-1801, 1824-1826, 1832, 1835-1836, 1859, 1866, 1870-1873, 1878, 1880-1882, 1915-1917, 1924, 1945-1946, 1949, 2000-2001, 2035, 2064, 2066-2067, 2090, 2163, 2166, 2169-2172, 2178, 2181, 2184, 2186, 2194, 2255-2256, 2307, 2321, 2333, 2343, 2345, 2353, 2394-2395, 2403-2404, 2460-2462, 2489, 2491-2492, 2495, 2499, 2524-2525, 2527-2530, 2561-2562, 2591, 2595, 2616, 2644-2651, 2653-2654, 2661-2664, 2674, 2684, 2693-2695, 2725-2728, 2777-2782, 2784-2785, 2789, 2791-2792, 2794-2795, 2797, 2849-2852, or 2917-2918. In some aspects, the oligonucleotide comprises the nucleobase sequence of any one of SEQ ID NOs: 89, 102, 111, 116, 150, 154, 160-161, 163-164, 166, 168, 175-176, 178, 180, 183, 185-189, 201, 211-212, 229-231, 235-236, 238, 241, 250, 254, 265-269, 282-283, 286-288, 294, 296, 319, 322, 328, 366-368, 377, 379, 381-399, 511, 514-517, 567-568, 591, 593-594, 599, 602, 666, 669-670, 703, 728, 750-753, 755, 757, 784, 786-788, 828-830, 972, 974-977, 1002, 1004-1005, 1009, 1011-1012, 1110-1111, 1126, 1172, 1176-1181, 1272-1274, 1297, 1302, 1387, 1392-1393, 1461-1463, 1474, 1482, 1498-1500, 1502, 1505, 1508, 1510-1511, 1514, 1516-1518, 1525-1526, 1529-1530, 1546-1547, 1572, 1597, 1721-1722, 1725-1727, 1745-1746, 1800-1801, 1824, 1832, 1835-1836, 1859, 1866, 1870-1872, 1878, 1880-1882, 1916, 1924, 1946, 1949, 2000-2001, 2066, 2090, 2163, 2169-2171, 2178, 2181, 2186, 2255-2256, 2307, 2321, 2333, 2394, 2403-2404, 2460-2462, 2489, 2491-2492, 2495, 2499, 2524-2525, 2527-2530, 2561, 2591, 2616, 2644, 2646, 2649-2651, 2653-2654, 2661-2664, 2684, 2693-2695, 2726-2728, 2777-2780, 2782, 2784-2785, 2791-2792, 2794-2795, 2797, 2849-2850, 2852, or 2917-2918. In some aspects, the oligonucleotide comprises the nucleobase sequence of any one of SEQ ID NOs: 160-161, 163-164, 166, 211-212, 230-231, 267-268, 282, 294, 322, 366-367, 391-394, 399, 514-515, 594, 602, 728, 750, 752-753, 755, 828, 830, 975-976, 1002, 1176-1179, 1274, 1387, 1462-1463, 1510, 1514, 1529-1530, 1726-1727, 1745-1746, 1824, 1871-1872, 2090, 2256, 2528-2530, 2644, or 2792. In some aspects, the oligonucleotide comprises the nucleobase sequence of any one of SEQ ID NOs: 164, 186-187, 212, 235, 322, 367-368, 379, 384-385, 388-389, 391-392, 395, 515, 594, 703, 751-753, 828-830, 1005, 1176-1180, 1274, 1297, 1302, 1387, 1393, 1463, 1511, 1514, 1745, 1824, 1881, 2256, 2404, 2491, 2528, 2530, or 2646. In some aspects, the oligonucleotide comprises the nucleobase sequence of any one of SEQ ID NOs. 174-176,178,180-187, 566-569, 573, 701-704, 1260-1261, 1274-1277, 1510-1513, 2000-2001, 2194, 2196, 2661-2664, or 2666.

In some aspects, the nucleobase sequence of the oligonucleotide consists of any one of SEQ ID NOs: 6-4710. In some aspects, the oligonuclectide consists of the nucleobase sequence of any one of SEQ ID NOs: 89, 92, 102, 107-108, 110-111, 115-116, 150, 154, 160-161, 163-164, 166, 168, 175-176,178,180,182-183, 185-189, 201, 211-212, 229-231, 234-238, 241, 248-250, 254, 265-269, 282-283, 285-288, 294, 296, 319-322, 328-329, 366-367-368, 377-379, 381-399, 487-488, 511, 514-517, 520, 566-568, 573, 591, 593-594, 599, 602, 666, 669-670, 701-704, 728, 749-753, 755, 757, 784, 786-788, 790, 828-830, 959, 972, 974-977, 1002, 1004-1005, 1007, 1009-1013, 1086, 1110-1111, 1126, 1149, 1172, 1176-1181, 1185, 1260, 1271-1274, 1276-1277, 1297, 1302, 1387-1390, 1392-1393, 1396, 1461-1463, 1473-1474, 1482, 1490-1491, 1495, 1498-1502, 1505, 1508, 1510-1514, 1516-1518, 1525-1526, 1529-1530, 1546-1547, 1572, 1596-1597, 1721-1722, 1724-1725-1726-1727, 1744-1746, 1797, 1800-1802, 1824-1826, 1832, 1835-1836, 1859, 1865-1866, 1870-1873, 1875, 1878, 1880-1882, 1911, 1914-1918, 1924, 1945-1946, 1949, 2000-2001, 2035, 2064, 2066-2067, 2090-2091, 2163, 2166, 2169-2172, 2178, 2181, 2184, 2186, 2194, 2255-2256, 2307, 2321, 2333, 2343, 2345-2346, 2353-2355, 2394-2395, 2403-2404, 2460-2462, 2489-2492, 2495, 2499-2500, 2524-2530, 2561-2562, 2591, 2595, 2616, 2644-2651, 2653-2654, 2661-2664, 2674, 2683-2685, 2687, 2690-2691, 2693-2695, 2725-2728, 2777-2782, 2784-

2785, 2789, 2791-2792, 2794-2795, 2797, 2848-2852, or 2917-2918. In some aspects, the oligonucleotide consists of the nucleobase sequence of any one of SEQ ID NOs. 89, 92, 102, 107-108, 111, 116, 150, 154, 160-161, 163-164, 166, 168, 175-176,178,180,182-183, 185-189, 201, 211-212, 229-231, 234-236, 238, 241, 248-250, 254, 265-269, 282-283, 285-288, 294, 296, 319-320, 322, 328-329, 366-368, 377, 379, 381-399, 487-488, 511, 514-517, 520, 566-568, 573, 591, 593-594, 599, 602, 666, 669-670, 701-704, 728, 750-753, 755, 757, 784, 786-788, 790, 828-830, 972, 974-977, 1002, 1004-1005, 1009-1013, 1110-1111, 1126, 1172, 1176-1181, 1271-1274,1276-1277, 1297, 1302, 1387, 1390, 1392-1393, 1461-1462-1463, 1474, 1482, 1490-1491, 1498-1502, 1505, 1508, 1510-1512, 1514, 1516-1518, 1525-1526, 1529-1530, 1546-1547,1572,1597,1721-1722, 1724-1727, 1744-1746, 1797, 1800-1801, 1824-1826, 1832, 1835-1836, 1859, 1866, 1870-1873, 1878, 1880-1882, 1915-1917, 1924, 1945-1946, 1949, 2000-2001, 2035, 2064, 2066-2067, 2090, 2163, 2166, 2169-2172, 2178, 2181, 2184, 2186, 2194, 2255-2256, 2307, 2321, 2333, 2343, 2345, 2353, 2394-2395, 2403-2404, 2460-2462, 2489, 2491-2492, 2495, 2499, 2524-2525, 2527-2530, 2561-2562, 2591, 2595, 2616, 2644-2651, 2653-2654, 2661-2664, 2674, 2684, 2693-2695, 2725-2728, 2777-2782, 2784-2785, 2789, 2791-2792, 2794-2795, 2797, 2849-2852, or 2917-2918 In some aspects, the oligonucleotide consists of the nucleobase sequence of any one of SEQ ID NOs: 89, 102, 111, 116, 150, 154, 160-161, 163-164, 166, 168, 175-176, 178, 180, 183, 185-189, 201, 211-212, 229-231, 235-236, 238, 241, 250, 254, 265-269, 282-283, 286-288, 294, 296, 319, 322, 328, 366-368, 377, 379, 381-399, 511, 514-517, 567-568, 591, 593-594, 599, 602, 666, 669-670, 703, 728, 750-753, 755, 757, 784, 786-788, 828-830, 972, 974-977, 1002, 1004-1005, 1009, 1011-1012, 1110-1111, 1126, 1172, 1176-1181, 1272-1274, 1297, 1302, 1387, 1392-1393, 1461-1463, 1474, 1482, 1498-1500, 1502, 1505, 1508, 1510-1511, 1514, 1516-1518, 1525-1526, 1529-1530, 1546-1547, 1572, 1597, 1721-1722, 1725-1727, 1745-1746, 1800-1801, 1824, 1832, 1835-1836, 1859, 1866, 1870-1872, 1878, 1880-1882, 1916, 1924, 1946, 1949, 2000-2001, 2066, 2090, 2163, 2169-2171, 2178, 2181, 2186, 2255-2256, 2307, 2321, 2333, 2394, 2403-2404, 2460-2462, 2489, 2491-2492, 2495, 2499, 2524-2525, 2527-2530, 2561, 2591, 2616, 2644, 2646, 2649-2651, 2653-2654, 2661-2664, 2684, 2693-2695, 2726-2728, 2777-2780, 2782, 2784-2785, 2791-2792, 2794-2795, 2797, 2849-2850, 2852, or 2917-2918. In some aspects, the oligonucleotide consists of the nucleobase sequence of any one of SEQ ID NOs: 160-161, 163-164, 166, 211-212, 230-231, 267-268, 282, 294, 322, 366-367, 391-394, 399, 514-515, 594, 602, 728, 750, 752-753, 755, 828, 830, 975-976, 1002, 1176-1179, 1274, 1387, 1462-1463, 1510, 1514, 1529-1530, 1726-1727, 1745-1746, 1824, 1871-1872, 2090, 2256, 2528-2530, 2644, or 2792. In some aspects, the oligonucleotide consists of the nucleobase sequence of any one of SEQ ID NOs: 164, 186-187, 212, 235, 322, 367-368, 379, 384-385, 388-389, 391-392, 395, 515, 594, 703, 751-753, 828-830, 1005, 1176-1180, 1274, 1297, 1302, 1387, 1393, 1463, 1511, 1514, 1745, 1824, 1881, 2256, 2404, 2491, 2528, 2530, or 2646 In some aspects, the oligonucleotide consists of the nucleobase sequence of any one of SEQ ID NOs: 174-176, 178, 180-187, 566-569, 573, 701-704, 1260-1261, 1274-1277, 1510-1513, 2000-2001, 2194, 2196, 2661-2664, or 2666

In some aspects, the oligonucleotide exhibits at least 50% mRNA inhibition at 20 nM oligonucleotide concentration when determined using a cell assay when compared with a control cell. In some aspects, the oligonucleotide exhibits at least 60% mRNA inhibition at a 20 nM oligonucleotide concentration when determined using a cell assay when compared with a control cell. In some aspects, the oligonucleotide exhibits at least 70% mRNA inhibition at a 20 nM oligonucleotide concentration when determined using a cell assay when compared with a control cell. In some aspects, the oligonucleotide exhibits at least 85% mRNA inhibition at a 20 nM oligonucleotide concentration when determined using a cell assay when compared with a control cell. In some aspects, the oligonucleotide exhibits at least 50% mRNA inhibition at a 2 nM oligonucleotide concentration when determined using a cell assay when compared with a control cell. In some aspects, the oligonucleotide exhibits at least 60% mRNA inhibition at a 2 nM oligonucleotide concentration when determined using a cell assay when compared with a control cell. In some aspects, the oligonucleotide exhibits at least 70% mRNA inhibition at a 2 nM oligonucleotide concentration when determined using a cell assay when compared with a control cell. In some aspects, the oligonucleotide exhibits at least 85% mRNA inhibition at a 2 nM oligonucleotide concentration when determined using a cell assay when compared with a control cell. The cell assay can comprise transfecting a mammalian cell, such as HEK293, NIH3T3, or HeLa, with oligonucleotides using LIPOFECTAMINE™ 2000 (Invitrogen) and measuring mRNA levels compared to a mammalian cell transfected with a mock oligonucleotide. In some aspects, the oligonucleotide comprises at least one alternative internucleoside linkage. In some aspects, the at least one alternative internucleoside linkage is a phosphorothioate internucleoside linkage. In some aspects, the at least one alternative internucleoside linkage is a 2'-alkoxy internucleoside linkage. In some aspects, the at least one alternative internucleoside linkage is an alkyl phosphate intemudeoside linkage.

In some aspects, the oligonucleotide comprises at least one alternative nucleobase. In some aspects, the alternative nucleobase is 5-methylcytosine, pseudouridine, or 5-methoxyuridine.

In some aspects, the oligonucleotide comprises at least one alternative sugar moiety. In some aspects, the alternative sugar moiety is 2-OMe or a bicyclic nucleic acid.

In some aspects, the oligonucleotide further comprises a ligand conjugated to the 5' end or the 3' end of the oligonucleotide through a monovalent or branched bivalent or trivalent linker.

In some aspects, the oligonucleotide comprises a region complementary to at least 17 contiguous nucleotides of a MLH3 gene. In some aspects, the oligonucleotide comprises a region complementary to at least 19 contiguous nucleotides of a MLH3 gene. In some aspects, the oligonucleotide comprises a region complementary to 19 to 23 contiguous nucleotides of a MLH3 gene. In some aspects, the oligonucleotide comprises a region complementary to 19 contiguous nucleotides of a MLH3 gene. In some aspects, the oligonucleotide comprises a region complementary to 20 contiguous nucleotides of a MLH3 gene. In some aspects, the oligonucleotide is from about 15 to 25 nucleosides in length. In some aspects, the oligonucleotide is 20 nucleosides in length.

Pharmaceutical Compositions and Methods of Treatment Using the Same

In some aspects, the application is directed to a pharmaceutical composition comprising one or more of the oligonucleotides described herein and a pharmaceutically acceptable carrier or excipient.

In some aspects, the application is directed to a composition comprising one or more of the oligonucleotides described herein and a lipid nanoparticle, a polyplex nanoparticle, a lipoplex nanoparticle, or a liposome.

In some aspects, the application is directed to a method of inhibiting transcription of MLH3 in a cell, the method comprising contacting the cell with one or more of the oligonucleotides described herein, a pharmaceutical composition of one or more of the oligonucleotides described herein, or the composition of one or more oligonucleotides described herein and a lipid nanoparticle, a polyplex nanoparticle, a lipoplex nanoparticle, or a liposome; for a time sufficient to obtain degradation of an mRNA transcript of a MLH3 gene, inhibiting expression of the MLH3 gene in the cell.

In some aspects, the application is directed to a method of treating, preventing, or delaying the progression a trinucleotide repeat expansion disorder in a subject in need thereof, the method comprising contacting the cell with one or more of the oligonucleotides described herein, a pharmaceutical composition of one or more of the oligonucleotides described herein, or the composition of one or more oligonucleotides described herein and a lipid nanoparticle, a polyplex nanoparticle, a lipoplex nanoparticle, or a liposome; for a time sufficient to obtain degradation of an mRNA transcript of a MLH3 gene, inhibiting expression of the MLH3 gene in the cell.

In some aspects, the application is directed to a method of reducing the level and/or activity of MLH3 in a cell of a subject identified as having a trinucleotide repeat expansion disorder, the method comprising contacting the cell with one or more of the oligonucleotides described herein, a pharmaceutical composition of one or more of the oligonucleotides described herein, or the composition of one or more oligonucleotides described herein and a lipid nanoparticle, a polyplex nanoparticle, a lipoplex nanoparticle, or a liposome, for a time sufficient to obtain degradation of an mRNA transcript of a MLH3 gene, inhibiting expression of the MLH3 gene in the cell.

In some aspects, the application is directed to a method for inhibiting expression of an MLH3 gene in a cell comprising contacting the cell with one or more of the oligonucleotides described herein, a pharmaceutical composition of one or more of the oligonucleotides described herein, or the composition of one or more oligonucleotides described herein and a lipid nanoparticle, a polyplex nanoparticle, a lipoplex nanoparticle, or a liposome; for a time sufficient to obtain degradation of an mRNA transcript of a MLH3 gene, inhibiting expression of the MLH3 gene in the cell, and maintaining the cell for a time sufficient to obtain degradation of a mRNA transcript of an MLH3 gene, thereby inhibiting expression of the MLH3 gene in the cell.

In some aspects, the application is directed to a method of decreasing trinucleotide repeat expansion in a cell, the method comprising contacting the cell with one or more of the oligonucleotides described herein, a pharmaceutical composition of one or more of the oligonucleotides described herein, or the composition of one or more oligonucleotides described herein and a lipid nanoparticle, a polyplex nanoparticle, a lipoplex nanoparticle, or a liposome; for a time sufficient to obtain degradation of an mRNA transcript of a MLH3 gene, inhibiting expression of the MLH3 gene in the cell.

In some aspects, the cell is in a subject. In some aspects, the subject is a human. In some aspects, the cell is a cell of the central nervous system or a muscle cell.

In some aspects, the subject is identified as having a trinucleotide repeat expansion disorder. In some aspects, the trinucleotide repeat expansion disorder is a polyglutamine disease. In some aspects, the polyglutamine disease is selected from the group consisting of dentatorubropallidoluysian atrophy, Huntington's disease, spinal and bulbar muscular atrophy, spinocerebellar ataxia type 1, spinocerebellar ataxia type 2, spinocerebellar ataxia type 3, spinocerebellar ataxia type 6, spinocerebellar ataxia type 7, spinocerebellar ataxia type 17, and Huntington's disease-like 2. In some aspects, the trinucleotide repeat expansion disorder is Huntington's disease.

In some aspects, the trinucleotide repeat expansion disorder is a non-polyglutamine disease. In some aspects, the non-polyglutamine disease is selected from the group consisting of fragile X syndrome, fragile X-associated tremor/ataxia syndrome, fragile XE mental retardation, Friedreich's ataxia, myotonic dystrophy type 1, spinocerebellar ataxia type 8, spinocerebellar ataxia type 12, oculopharyngeal muscular dystrophy, Fragile X-associated premature ovarian failure, FRA2A syndrome, FRA7A syndrome, and early infantile epileptic encephalopathy. In some aspects, the trinucleotide repeat expansion disorder is Friedreich's ataxia. In some aspects, the trinucleotide repeat expansion disorder is myotonic dystrophy type 1.

In some aspects, the application is directed one or more of the oligonucleotides described herein, a pharmaceutical composition of one or more of the oligonucleotides described herein, or the composition of one or more oligonucleotides described herein and a lipid nanoparticle, a polyplex nanoparticle, a lipoplex nanoparticle, or a liposome, for use in the prevention or treatment of a trinucleotide repeat expansion disorder.

In some aspects, the one or more of the oligonucleotides described herein, the pharmaceutical composition of one or more of the oligonucleotides described herein, or the composition of one or more oligonucleotides described herein and a lipid nanoparticle, a polyplex nanoparticle, a lipoplex nanoparticle, or a liposome is administered intrathecally.

In some aspects, the one or more of the oligonucleotides described herein, the pharmaceutical composition of one or more of the oligonucleotides described herein, or the composition of one or more oligonucleotides described herein and a lipid nanoparticle, a polyplex nanoparticle, a lipoplex nanoparticle, or a liposome is administered intraventricularly.

In some aspects, the one or more of the oligonucleotides described herein, the pharmaceutical composition of one or more of the oligonucleotides described herein, or the composition of one or more oligonucleotides described herein and a lipid nanoparticle, a polyplex nanoparticle, a lipoplex nanoparticle, or a liposome is administered intramuscularly.

In some aspects, the application is directed to a method of treating, preventing, or delaying progression a disorder in a subject in need thereof wherein the subject is suffering from trinucleotide repeat expansion disorder, comprising administering to said subject one or more of the oligonucleotides described herein, the pharmaceutical composition of one or more of the oligonucleotides described herein, or the composition of one or more oligonucleotides described herein and a lipid nanoparticle, a polyplex nanoparticle, a lipoplex nanoparticle, or a liposome.

In some aspects, the method of treating, preventing, or delaying progression of a disorder in a subject further comprises administering an additional therapeutic agent. In some aspects, the additional therapeutic agent is another oligonucleotide that hybridizes to an mRNA encoding the Huntingtin gene.

In some aspects, the method of treating, preventing, or delaying progression of a disorder in a subject progression delays progression of the trinucleotide repeat expansion disorder by at least 120 days, for example, at least 6 months, at least 12 months, at least 2 years, at least 3 years, at least 4 years, at least 5 years, at least 10 years or more, when compared with a predicted progression.

In some aspects, the application is directed to one or more of the oligonucleotides described herein, the pharmaceutical composition of one or more of the oligonucleotides described herein, or the composition of one or more oligonucleotides described herein and a lipid nanoparticle, a polyplex nanoparticle, a lipoplex nanoparticle, or a liposome for use in preventing or delaying progression of a trinucleotide repeat expansion disorder in a subject

Definitions

For convenience, the meaning of some terms and phrases used in the specification, examples, and appended claims are provided below. Unless stated otherwise, or implicit from context, the following terms and phrases include the meanings provided below. The definitions are provided to aid in describing particular aspects, and are not intended to limit the claimed technology, because the scope of the technology is limited only by the claims. Unless otherwise defined, all technical and scientific terms used herein have the same meaning as commonly understood by one of ordinary skill in the art to which this technology belongs. If there is an apparent discrepancy between the usage of a term in the art and its definition provided herein, the definition provided within the specification shall prevail.

In this application, unless otherwise clear from context, (i) the term 'a' can be understood to mean 'at least one'; (ii) the term 'or' can be understood to mean "and/or"; and (iii) the terms 'including' and 'comprising' can be understood to encompass itemized components or steps whether presented by themselves or together with one or more additional components or steps.

As used herein, the terms 'about' and "approximately" refer to a value that is within 10% above or below the value being described. For example, the term "about 5 nM" indicates a range of from 4.5 to 5.5 nM.

The term 'at least' prior to a number or series of numbers is understood to include the number adjacent to the term "at least", and all subsequent numbers or integers that could logically be included, as clear from context. For example, the number of nucleotides in a nucleic acid molecule must be an integer. For example, "at least 18 nucleotides of a 21-nucleotide nucleic acid molecule" means that 18, 19, 20, or 21 nucleotides have the indicated property. When at least is present before a series of numbers or a range, it is understood that "at least" can modify each of the numbers in the series or range. "At least" is also not limited to integers (e.g., "at least 5%" includes 5.0%, 5.1%, 5.18% without consideration of the number of significant figures. As used herein, "no more than" or "less than" is understood as the value adjacent to the phrase and logical lower values or integers, as logical from context, to zero. For example, an oligonucleotide with "no more than 3 mismatches to a target sequence" has 3, 2, 1, or 0 mismatches to a target sequence. When "no more than" is present before a series of numbers or a range, it is understood that "no more than" can modify each of the numbers in the series or range. As used herein, the term "administration" refers to the administration of a composition (e.g., a compound or a preparation that includes a compound as described herein) to a subject or system. Administration to an animal subject (e.g., to a human) can be by any appropriate route, such as one described herein.

As used herein, a "combination therapy" or"administered in combination" means that two (or more) different agents or treatments are administered to a subject as part of a defined treatment regimen for a particular disease or condition. The treatment regimen defines the doses and periodicity of administration of each agent such that the effects of the separate agents on the subject overlap. In some aspects, the delivery of the two or more agents is simultaneous or concurrent and the agents can be co-formulated. In some aspects, the two or more agents are not co-formulated and are administered in a sequential manner as part of a prescribed regimen. In some aspects, administration of two or more agents or treatments in combination is such that the reduction in a symptom, or other parameter related to the disorder is greater than what would be observed with one agent or treatment delivered alone or in the absence of the other. The effect of the two treatments can be partially additive, wholly additive, or greater than additive (e.g., synergistic). Sequential or substantially simultaneous administration of each therapeutic agent can be effected by any appropriate route including, but not limited to, oral routes, intravenous routes, intramuscular routes, and direct absorption through mucous membrane tissues. The therapeutic agents can be administered by the same route or by different routes. For example, one therapeutic agent of the combination can be administered by intravenous injection while another therapeutic agent of the combination can be administered orally.

As used herein, the term "MLH3" refers to mutL homolog 3, a DNA mismatch repair protein, having an amino acid sequence from any vertebrate or mammalian source, including, but not limited to, human, bovine, chicken, rodent, mouse, rat, porcine, ovine, primate, monkey, and guinea pig, unless specified otherwise. The term also refers to fragments and variants of native MLH3 that maintain at least one in vivo or in vitro activity of a native MLH3. The term encompasses full-length unprocessed precursor forms of MLH3 as well as mature forms resulting from post-translational cleavage of the signal peptide. MLH3 is encoded by the MLH3 gene. The nucleic acid sequence of an exemplary *Homo sapiens* (human) MLH3 gene is set forth in NCBI Reference No. NM_001040108.1 or in SEQ ID NO: 1. The term "MLH3" also refers to natural variants of the wild-type MLH3 protein, such as proteins having at least 85% identity (e.g., 85%, 86%, 87%, 88%, 89%, 90%, 91%, 92%, 93%, 94%, 95%, 96%, 97%, 98%, 99%, 99.9% identity, or more) to the amino acid sequence of wild-type human MLH3, which is set forth in NCBI Reference No. NP_001035197.1 or in SEQ ID NO: 2. The nucleic acid sequence of an exemplary *Mus musculus* (mouse) MLH3 gene is set forth in NCBI Reference No. NM_175337.2 or in SEQ ID NO: 3. The nucleic acid sequence of an exemplary *Rattus norvegicus* (rat) MLH3 gene is set forth in NCBI Reference No. NM_001108043.1 or in SEQ ID NO: 4. The nucleic acid sequence of an exemplary *Macaca fascicularis* (cyno) MLH3 gene is set forth in NCBI Reference XM_005561790.2 or in SEQ ID NO: 5. The term "MLH3" as used herein, also refers to a particular polypeptide expressed in a cell by naturally occurring DNA sequence variations of the MLH3 gene, such as a single nucleotide polymorphism in the MLH3 gene. Numerous SNPs within the MLH3 gene have been identified and can be found at, for example, NCBI dbSNP (see, e.g., www.ncbi.nlm.nih.gov/snp). Non-limiting examples of SNPs within the MLH3 gene can be found at, NCBI dbSNP Accession Nos.: rs28757011; rs28756991; rs28756990; rs28756982;

rs28756981; rs17782839; rs7156586; rs175081; rs175080; rs175057; rs175049; rs108621; rs13712; and rs7303.

As used herein, "target sequence" refers to a contiguous portion of the nucleotide sequence of an mRNA molecule formed during the transcription of an MLH3 gene, including mRNA that is a product of RNA processing of a primary transcription product. In one aspect, the target portion of the sequence will be at least long enough to serve as a substrate for oligonucleotide-directed (e.g., antisense oligonucleotide (ASO)-directed) cleavage at or near that portion of the nucleotide sequence of an mRNA molecule formed during the transcription of a MLH3 gene. The target sequence can be, for example, from about 9-36 nucleotides in length, e.g., about 15-30 nucleotides in length. For example, the target sequence can be 15, 16, 17, 18, 19, 20, 21, 22, 23, 24, 25, 26, 27, 28, 29, or 30 or from about 15-30 nucleotides, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24,20-23, 20-22, 20-21, 21-30, 21-29, 21-28, 21-27, 21-26, 21-25, 21-24, 21-23, or 21-22 nucleotides in length. Ranges and lengths intermediate to the above recited ranges and lengths are also contemplated to be.

"G," "C," "A," "T," and "U" each generally stand for a naturally-occurring nucleotide that contains guanine, cytosine, adenine, thymidine, and uracil as a base, respectively. However, it will be understood that the term "nucleotide" can refer to an alternative nucleotide, as further detailed below, or a surrogate replacement moiety. The skilled person is well aware that guanine, cytosine, adenine, and uracil can be replaced by other moieties without substantially altering the base pairing properties of an oligonucleotide comprising a nucleotide bearing such replacement moiety. For example, without limitation, a nucleotide comprising inosine as its base can base pair with nucleotides containing adenine, cytosine, or uracil. Hence, nucleotides containing uracil, guanine, or adenine can be replaced in the nucleotide sequences of oligonucleotides described herein by a nucleotide containing, for example, inosine. In another example, adenine and cytosine anywhere in the oligonucleotide can be replaced with guanine and uracil, respectively to form G-U Wobble base pairing with the target mRNA. Sequences containing such replacement moieties are suitable for the compositions and methods described herein.

The terms "nucleobase" and "base" include the purine (e.g. adenine and guanine) and pyrimidine (e.g. uracil, thymine, and cytosine) moiety present in nucleosides and nucleotides which form hydrogen bonds in nucleic acid hybridization. The term nucleobase also encompasses alternative nucleobases which can differ from naturally-occurring nucleobases, but are functional during nucleic acid hybridization. In this context "nucleobase" refers to both naturally occurring nucleobases such as adenine, guanine, cytosine, thymidine, uracil, xanthine, and hypoxanthine, as well as alternative nucleobases. Such variants are for example described in Hirao et al (2012) Accounts of Chemical Research vol 45 page 2055 and Bergstrom (2009) Current Protocols in Nucleic Acid Chemistry Suppl 37.1.4.1.

The term "nucleoside" refers to a monomeric unit of an oligonucleotide or a polynucleotide having a nucleobase and a sugar moiety A nucleoside can include those that are naturally-occurring as well as alternative nucleosides, such as those described herein. The nucleobase of a nucleoside can be a naturally-occurring nucleobase or an alternative nucleobase. Similarly, the sugar moiety of a nucleoside can be a naturally-occurring sugar or an alternative sugar.

The term "alternative nucleoside" refers to a nucleoside having an alternative sugar or an alternative nucleobase, such as those described herein.

In some aspects, the nucleobase moiety is modified by changing the purine or pyrimidine into a modified punne or pyrimidine, such as substituted purine or substituted pyrimidine, such as an "alternative nucleobase" selected from isocytosine, pseudoisocytosine, 5-methyl cytosine, 5-thiozolo-cytosine, 5-propynyl-cytosine, 5-propynyl-uridine, 5-bromouridine 5-thiazolo-uridine, 2-thio-uridine, pseudouridine, 1-methylpseudouridine, 5-methoxyuridine, 2'-thio-thymine, inosine, diaminopurine, 6-aminopurine, 2-aminopurine, 2,6-diaminopurine, and 2-chloro-6-aminopurine. The nucleobase moieties can be indicated by the letter code for each corresponding nucleobase, e.g. A, T, G, C, or U, wherein each letter can include alternative nucleobases of equivalent function. In some aspects, e.g., for gapmers, 5-methyl cytosine LNA nucleosides can be used.

A "sugar" or "sugar moiety," includes naturally occurring sugars having a furanose ring. A sugar also includes an "alternative sugar," defined as a structure that is capable of replacing the furanose ring of a nucleoside. In some aspects, alternative sugars are non-furanose (or 4'-substituted furanose) rings or ring systems or open systems Such structures include simple changes relative to the natural furanose ring, such as a six-membered ring, or can be more complicated as is the case with the non-ring system used in peptide nucleic acid. Alternative sugars can include sugar surrogates wherein the furanose ring has been replaced with another ring system such as, for example, a morpholino or hexitol ring system. Sugar moieties useful in the preparation of oligonucleotides having motifs include, without limitation, β-D-ribose, β-D-2'-deoxyribose, substituted sugars (such as 2', 5' and bis substituted sugars), 4'-S-sugars (such as 4'-S-ribose, 4'-S-2'-deoxyribose and 4'-S-2'-substituted ribose), bicyclic alternative sugars (such as the 2'-O-$CH_2$-4' or 2'-O—($CH_2$)2-4' bridged ribose derived bicyclic sugars) and sugar surrogates (such as when the ribose ring has been replaced with a morpholino or a hexitol ring system). The type of heterocyclic base and internucleoside linkage used at each position is variable and is not a factor in determining the motif. In most nucleosides having an alternative sugar moiety, the heterocyclic nucleobase is generally maintained to permit hybridization.

A "nucleotide," as used herein, refers to a monomeric unit of an oligonucleotide or polynucleotide that comprises a nucleoside and an internucleosidic linkage. The intemucleosidic linkage can include a phosphate linkage. Similarly, "linked nucleosides" can be linked by phosphate linkages. Many "alternative intemucleosidic linkages' are known in the art, including, but not limited to, phosphate, phosphorothioate, and boronophosphate linkages Alternative nucleosides include bicyclic nucleosides (BNAs) (e.g., locked nucleosides (LNAs) and constrained ethyl (cEt) nucleosides), peptide nucleosides (PNAs), phosphotriesters, phosphorothionates, phosphoramidates, and other variants of the phosphate backbone of native nucleoside, including those described herein.

An "alternative nucleotide," as used herein, refers to a nucleotide having an alternative nucleoside or an alternative sugar, and an internucleoside linkage, which can include alternative nucleoside linkages.

The terms "oligonucleotide" and "polynucleotide," as used herein, are defined as it is generally understood by the skilled person as a molecule comprising two or more covalently linked nucleosides. Such covalently bound nucleosides can be referred to as nucleic acid molecules or oligomers. Oligonucleotides are commonly made in the laboratory by solid-phase chemical synthesis followed by purification. When referring to a sequence of the oligonucleotide, reference is made to the sequence or order of nucleobase moieties, or modifications thereof, of the covalently linked nucleotides or nucleosides. The oligonucleotide can be man-made. For example, the oligonucleotide can be chemically synthesized, and be purified or isolated. Oligonucleotide is also intended to include (i) compounds that have one or more furanose moieties that are replaced by furanose derivatives or by any structure, cyclic or acyclic, that can be used as a point of covalent attachment for the base moiety, (ii) compounds that have one or more phosphodiester linkages that are either modified, as in the case of phosphoramidate or phosphorothioate linkages, or completely replaced by a suitable linking moiety as in the case of formacetal or riboacetal linkages, and/or (iii) compounds that have one or more linked furanose-phosphodiester linkage moieties replaced by any structure, cyclic or acyclic, that can be used as a point of covalent attachment for the base moiety. The oligonucleotide can comprise one or more alternative nucleosides or nucleotides (e.g., including those described herein). It is also understood that oligonucleotide includes compositions lacking a sugar moiety or nucleobase but is still capable of forming a pairing with or hybridizing to a target sequence.

"Oligonucleotide" refers to a short polynucleotide (e.g., of 100 or fewer linked nucleosides).

"Chimeric" oligonucleotides or "chimeras," as used herein, are oligonucleotides which contain two or more chemically distinct regions, each made up of at least one monomer unit, i.e., a nucleotide or nucleoside in the case of an oligonucleotide. Chimeric oligonucleotides also include "gapmers."

The oligonucleotide can be of any length that permits specific degradation of a desired target RNA through an RNase H-mediated pathway, and can range from about 10-30 nucleosides in length, e.g., about 15-30 nucleosides in length or about 18-20 nucleosides in length, for example, about 10, 11, 12, 13, 14, 15, 16, 17, 18, 19, 20, 21, 22, 23, 24, 25, 26, 27, 28, 29, or 30 nucleosides in length, such as about 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24,20-23, 20-22, 20-21, 21-30, 21-29, 21-28, 21-27, 21-26, 21-25, 21-24, 21-23, or 21-22 nucleosides in length. Ranges and lengths intermediate to the above recited ranges and lengths are also contemplated.

As used herein, the term "oligonucleotide comprising a nucleobase sequence" refers to an oligonucleotide comprising a chain of nucleotides or nucleosides that is described by the sequence referred to using the standard nucleotide nomenclature.

The term "contiguous nucleobase region" refers to the region of the oligonucleotide which is complementary to the target nucleic acid. The term can be used interchangeably herein with the term "contiguous nucleotide sequence" or "contiguous nucleobase sequence." In some aspects, all the nucleotides of the oligonucleotide are present in the contiguous nucleotide or nucleoside region. In some aspects, the oligonucleotide comprises the contiguous nucleotide region and can comprise further nucleotide(s) or nucleoside(s), for example a nucleotide linker region which can be used to attach a functional group to the contiguous nucleotide sequence. The nucleotide linker region can be complementary to the target nucleic acid. In some aspects, the internucleoside linkages present between the nucleotides of the contiguous nucleotide region are all phosphorothioate internucleoside linkages. In some aspects, the contiguous nucleotide region comprises one or more sugar-modified nucleosides.

The term "gapmer," as used herein, refers to an oligonucleotide which comprises a region of RNase H recruiting oligonucleotides (gap or DNA core) which is flanked 5' and 3' by regions which comprise one or more affinity enhancing alternative nucleosides (wings or flanking sequence). Various gapmer designs are described herein. Headmers and tailmers are oligonucleotides capable of recruiting RNase H where one of the flanks is missing, i.e. only one of the ends of the oligonucleotide comprises affinity enhancing alternative nucleosides. For headmers the 3' flanking sequence is missing (i.e. the 5' flanking sequence comprises affinity enhancing alternative nucleosides) and for tailmers the 5' flanking sequence is missing (i.e. the 3' flanking sequence comprises affinity enhancing alternative nucleosides) A "mixed flanking sequence gapmer" refers to a gapmer wherein the flanking sequences comprise at least one alternative nucleoside, such as at least one DNA nucleoside or at least one 2' substituted alternative nucleoside, such as, for example, 7-O-alkyl-RNA, 7-O-methyl-RNA, 7-alkoxy-RNA, 2'-O-methoxyethyl-RNA (MOE), 7-amino-DNA, 2'-Fluoro-RNA, 7-F-ANA nucleoside(s), or bicyclic nucleosides (e.g., locked nucleosides or constrained ethyl (cEt) nucleosides). In some aspects, the mixed flanking sequence gapmer has one flanking sequence which comprises alternative nucleosides (e.g. 5' or 3') and the other flanking sequence (3' or 5' respectfully) comprises 2' substituted alternative nucleoside(s).

A "linker" or "linking group" is a connection between two atoms that links one chemical group or segment of interest to another chemical group or segment of interest via one or more covalent bonds. Conjugate moieties can be attached to the oligonucleotide directly or through a linking moiety (e g linker or tether). Linkers serve to covalently connect a third region, e.g. a conjugate moiety to an oligonucleotide (e.g. the termini of region A or C). In some aspects, the conjugate or oligonucleotide conjugate can comprise a linker region which is positioned between the oligonucleotide and the conjugate moiety. In some aspects, the linker between the conjugate and oligonucleotide is biocleavable. Phosphodiester containing biocleavable linkers are described in more detail in WO 2014/076195 (herein incorporated by reference).

As used herein, and unless otherwise indicated, the term "complementary," when used to describe a first nucleotide or nucleoside sequence in relation to a second nucleotide or nucleoside sequence, refers to the ability of an oligonucleotide or polynucleotide comprising the first nucleotide or nucleoside sequence to hybridize and form a duplex structure under certain conditions with an oligonucleotide or polynucleotide comprising the second nucleotide sequence, as will be understood by the skilled person Such conditions can, for example, be stringent conditions, where stringent conditions can include: 400 mM NaCl, 40 mM PIPES pH 6.4, 1 mM EDTA, 50° C., or 70° C., for 12-16 hours followed by washing (see, e.g., "Molecular Cloning: A Laboratory Manual, Sambrook, et al. (1989) Cold Spring Harbor Laboratory Press). Other conditions, such as physiologically relevant conditions as can be encountered inside an organism, can be used. The skilled person will be able to determine the set of conditions most appropriate for a test of complementarity of two sequences in accordance with the ultimate application of the hybridized nucleotides or nucleosides.

"Complementary" sequences, as used herein, can include, or be formed entirely from, non-Watson-Crick base pairs and/or base pairs formed from non-natural and alternative nucleotides or nucleosides, in so far as the above requirements with respect to their ability to hybridize are fulfilled. Such non-Watson-Crick base pairs include, but are not limited to, G:U Wobble or Hoogstein base pairing. Complementary sequences between an oligonucleotide and a target sequence as described herein, include base-pairing of the oligonucleotide or polynucleotide comprising a first nucleotide or nucleoside sequence to an oligonucleotide or polynucleotide comprising a second nucleotide or nucleoside sequence over the entire length of one or both nucleotide or nucleoside sequences. Such sequences can be referred to as "fully complementary" with respect to each other herein. However, where a first sequence is referred to as "substantially complementary" with respect to a second sequence herein, the two sequences can be fully complementary, or they can form one or more, but generally not more than 5, 4, 3 or 2 mismatched base pairs upon hybridization for a duplex up to 30 base pairs, while retaining the ability to hybridize under the conditions most relevant to their ultimate application, e.g., inhibition of gene expression via an RNase H-mediated pathway. "Substantially complementary" can refer to a polynucleotide that is substantially complementary to a contiguous portion of the mRNA of interest (e.g., an mRNA encoding MLH3). For example, a polynucleotide is complementary to at least a part of a MLH3 mRNA if the sequence is substantially complementary to a non-interrupted portion of an mRNA encoding MLH3.

As used herein, the term "region of complementarity" refers to the region on the oligonucleotide that is substantially complementary to all or a portion of a gene, primary transcript, a sequence (e.g., a target sequence, e.g., an MLH3 nucleotide sequence), or processed mRNA, so as to interfere with expression of the endogenous gene (e.g., MLH3). Where the region of complementarity is not fully complementary to the target sequence, the mismatches can be in the internal or terminal regions of the molecule. Generally, the most tolerated mismatches are in the terminal regions, e.g., within 5, 4, 3, or 2 nucleotides of the 5'- and/or 3'-terminus of the oligonucleotide.

As used herein, an "agent that reduces the level and/or activity of MLH3" refers to any polynucleotide agent (e.g., an oligonucleotide, e.g., an ASO) that reduces the level of or inhibits expression of MLH3 in a cell or subject. The phrase "inhibiting expression of MLH3," as used herein, includes inhibition of expression of any MLH3 gene (such as, e.g., a mouse MLH3 gene, a rat MLH3 gene, a monkey MLH3 gene, or a human MLH3 gene) as well as variants or mutants of a MLH3 gene that encode a MLH3 protein. Thus, the MLH3 gene can be a wild-type MLH3 gene, a mutant MLH3 gene, or a transgenic MLH3 gene in the context of a genetically manipulated cell, group of cells, or organism.

By "reducing the activity of MLH3," is meant decreasing the level of an activity related to MLH3 (e.g., by reducing the amount of trinucleotide repeats in a gene associated with a trinucleotide repeat expansion disorder that is related to MLH3 activity). The activity level of MLH3 can be measured using any method known in the art (e.g., by directly sequencing a gene associated with a trinucleotide repeat expansion disorder to measure the levels of trinucleotide repeats).

By "reducing the level of MLH3," is meant decreasing the level of MLH3 in a cell or subject, e.g., by administering an oligonucleotide to the cell or subject. The level of MLH3 can be measured using any method known in the art (e.g., by measuring the levels of MLH3 mRNA or levels of MLH3 protein in a cell or a subject).

By "modulating the activity of a MutLγ heterodimer comprising MLH3," is meant altering the level of an activity related to a MutLγ heterodimer (e.g., e.g., by altering the amount of trinucleotide repeats in a gene associated with a trinucleotide repeat expansion disorder that is related to a MutLγ heterodimer. The activity level of a MutLγ heterodimer can be measured using any method known in the art (e.g., by directly sequencing a gene associated with a trinucleotide repeat expansion disorder to measure the levels of trinucleotide repeats).

As used herein, the term "inhibitor" refers to any agent which reduces the level and/or activity of a protein (e.g., MLH3). Non-limiting examples of inhibitors include polynucleotides (e.g., oligonucleotide, e.g., ASOs). The term "inhibiting," as used herein, is used interchangeably with "reducing," "silencing," "downregulating," "suppressing," and other similar terms, and includes any level of inhibition.

As used herein, the term "selective for MLH3 over MLH1" refers to a compound which inhibits the level and/or activity of MLH3 at least 5% (e.g., at least 10%, at least 25%, at least 50%, at least 75%, or at least 100%) greater than the compound inhibits the level and/or activity of MLH1.

The phrase "contacting a cell with an oligonucleotide," such as an oligonucleotide, as used herein, includes contacting a cell by any possible means. Contacting a cell with an oligonucleotide includes contacting a cell in vitro with the oligonucleotide or contacting a cell in vivo with the oligonucleotide. The contacting can be done directly or indirectly Thus, for example, the oligonucleotide can be put into physical contact with the cell by the individual performing the method, or alternatively, the oligonucleotide agent can be put into a situation that will permit or cause it to subsequently come into contact with the cell.

Contacting a cell in vitro can be done, for example, by incubating the cell with the oligonucleotide. Contacting a cell in vivo can be done, for example, by injecting the oligonucleotide into or near the tissue where the cell is located, or by injecting the oligonucleotide agent into another area, e.g., the bloodstream or the subcutaneous space, such that the agent will subsequently reach the tissue where the cell to be contacted is located. For example, the oligonucleotide can contain and/or be coupled to a ligand, e.g., GalNAc3, that directs the oligonucleotide to a site of interest, e.g., the liver. Combinations of in vitro and in vivo methods of contacting are also possible. For example, a cell can be contacted in vitro with an oligonucleotide and subsequently transplanted into a subject.

In one aspect, contacting a cell with an oligonucleotide includes "introducing" or "delivering the oligonucleotide into the cell" by facilitating or effecting uptake or absorption into the cell. Absorption or uptake of an ASO can occur through unaided diffusive or active cellular processes, or by auxiliary agents or devices. Introducing an oligonucleotide into a cell can be in vitro and/or in vivo. For example, for in vivo introduction, oligonucleotides can be injected into a tissue site or administered systemically. In vitro introduction into a cell includes methods known in the art such as electroporation and lipofection. Further approaches are described herein below and/or are known in the art.

As used herein, "lipid nanoparticle" or "LNP" is a vesicle comprising a lipid layer encapsulating a pharmaceutically active molecule, such as a nucleic acid molecule, e.g., an oligonucleotide. LNP refers to a stable nucleic acid-lipid particle. LNPs typically contain a cationic lipid, a non-cationic lipid, and a lipid that prevents aggregation of the particle (e.g., a PEG-lipid conjugate). LNPs are described in, for example, U.S. Pat. Nos. 6,858,225; 6,815,432; 8,158,601; and 8,058,069, the entire contents of which are hereby incorporated herein by reference.

As used herein, the term "liposome" refers to a vesicle composed of amphiphilic lipids arranged in at least one bilayer, e.g., one bilayer or a plurality of bilayers. Liposomes include unilamellar and multilamellar vesicles that have a membrane formed from a lipophilic material and an aqueous interior. The aqueous portion contains the oligonucleotide composition. The lipophilic material isolates the aqueous interior from an aqueous exterior, which typically does not include the oligonucleotide composition, although in some examples, it can. Liposomes also include "sterically stabilized" liposomes, a term which, as used herein, refers to liposomes comprising one or more specialized lipids that, when incorporated into liposomes, result in enhanced circulation lifetimes relative to liposomes lacking such specialized lipids.

"Micelles" are defined herein as a particular type of molecular assembly in which amphipathic molecules are arranged in a spherical structure such that all the hydrophobic portions of the molecules are directed inward, leaving the hydrophilic portions in contact with the surrounding aqueous phase. The converse arrangement exists if the environment is hydrophobic.

The term "antisense," as used herein, refers to a nucleic acid comprising an oligonucleotide or polynucleotide that is sufficiently complementary to all or a portion of a gene, primary transcript, or processed mRNA, so as to interfere with expression of the endogenous gene (e.g., MLH3). "Complementary" polynucleotides are those that are capable of base pairing according to the standard Watson-Crick complementarity rules Specifically, purines will base pair with pyrimidines to form a combination of guanine paired with cytosine (G:C) and adenine paired with either thymine (A:T) in the case of DNA, or adenine paired with uracil (AU) in the case of RNA. It is understood that two polynucleotides can hybridize to each other even if they are not completely complementary to each other, provided that each has at least one region that is substantially complementary to the other.

As used herein, the terms "effective amount", "therapeutically effective amount," and "a "sufficient amount" of an agent that reduces the level and/or activity of MLH3 (e.g., in a cell or a subject) described herein refer to a quantity sufficient to, when administered to the subject, including a human, effect beneficial or desired results, including clinical results, and, as such, an "effective amount" or synonym thereto depends on the context in which it is being applied. For example, in the context of treating a trinucleotide repeat expansion disorder, it is an amount of the agent that reduces the level and/or activity of MLH3 sufficient to achieve a treatment response as compared to the response obtained without administration of the agent that reduces the level and/or activity of MLH3. The amount of a given agent that reduces the level and/or activity of MLH3 described herein that will correspond to such an amount will vary depending upon various factors, such as the given agent, the pharmaceutical formulation, the route of administration, the type of disease or disorder, the identity of the subject (e.g., age, sex, and/or weight) or host being treated, and the like, but can nevertheless be routinely determined by one of skill in the art. Also, as used herein, a "therapeutically effective amount" of an agent that reduces the level and/or activity of MLH3 of the present disclosure is an amount which results in a beneficial or desired result in a subject as compared to a control. As defined herein, a therapeutically effective amount of an agent that reduces the level and/or activity of MLH3 of the present disclosure can be readily determined by one of ordinary skill by routine methods known in the art. Dosage regimen can be adjusted to provide the optimum therapeutic response.

"Prophylactically effective amount," as used herein, is intended to include the amount of an oligonucleotide that, when administered to a subject having or predisposed to have a trinucleotide repeat expansion disorder, is sufficient to prevent or ameliorate the disease or one or more symptoms of the disease. Ameliorating the disease includes slowing the course of the disease or reducing the severity of later-developing disease. The "prophylactically effective amount" can vary depending on the oligonucleotide, how the agent is administered, the degree of risk of disease, and the history, age, weight, family history, genetic makeup, the types of preceding or concomitant treatments, if any, and other individual characteristics of the patient to be treated. A prophylactically effective amount can refer to, for example, an amount of the agent that reduces the level and/or activity of MLH3 (e.g., in a cell or a subject) described herein or can refer to a quantity sufficient to, when administered to the subject, including a human, delay the onset of one or more of the trinucleotide repeat disorders described herein by at least 120 days, for example, at least 6 months, at least 12 months, at least 2 years, at least 3 years, at least 4 years, at least 5 years, at least 10 years or more, when compared with the predicted onset.

A "therapeutically-effective amount" or "prophylactically effective amount" also includes an amount (either administered in a single or in multiple doses) of an oligonucleotide that produces some desired local or systemic effect at a reasonable benefit/risk ratio applicable to any treatment. Oligonucleotides employed in the methods described herein can be administered in a sufficient amount to produce a reasonable benefit/risk ratio applicable to such treatment.

As used herein, the term "region of complementarity" refers to the region on the oligonucleotide that is substantially complementary to all or a portion of a gene, primary transcript, a sequence (e.g., a target sequence, e.g., an MLH3 nucleotide sequence), or processed mRNA, so as to interfere with expression of the endogenous gene (e.g., MLH3). Where the region of complementanty is not fully complementary to the target sequence, the mismatches can be in the internal or terminal regions of the molecule. Generally, the most tolerated mismatches are in the terminal regions, e.g., within 5, 4, 3, or 2 nucleotides of the 5'- and/or 3'-terminus of the oligonucleotide.

An "amount effective to reduce trinucleotide repeat expansion" of a particular gene refers to an amount of the agent that reduces the level and/or activity of MLH3 (e.g., in a cell or a subject) described herein, or to a quantity sufficient to, when administered to the subject, including a human, to reduce the trinucleotide repeat expansion of a particular gene (e.g., a gene associated with a trinucleotide repeat expansion disorder described herein).

As used herein, the term "a subject identified as having a trinucleotide repeat expansion disorder" refers to a subject identified as having a molecular or pathological state, disease or condition of or associated with a trinucleotide repeat expansion disorder, such as the identification of a trinucleotide repeat expansion disorder or symptoms thereof, or to identification of a subject having or suspected of having a trinucleotide repeat expansion disorder who can benefit from a particular treatment regimen.

As used herein, "trinucleotide repeat expansion disorder" refers to a class of genetic diseases or disorders characterized by excessive trinucleotide repeats (e.g., trinucleotide repeats such as CAG) in a gene or intron in the subject which exceed the normal, stable threshold, for the gene or intron. Nucleotide repeats are common in the human genome and are not normally associated with disease. In some cases, however, the number of repeats expands beyond a stable threshold and can lead to disease, with the severity of symptoms generally correlated with the number of repeats. Trinucleotide repeat expansion disorders include 'polyglutamine' and "non-polyglutamine" disorders.

By "determining the level of a protein" is meant the detection of a protein, or an mRNA encoding the protein, by methods known in the art either directly or indirectly. "Directly determining" means performing a process (e.g., performing an assay or test on a sample or analyzing a sample"as that term is defined herein) to obtain the physical entity or value. "Indirectly determining" refers to receiving the physical entity or value from another party or source (e.g., a third-party laboratory that directly acquired the physical entity or value). Methods to measure protein level generally include, but are not limited to, western blotting, immunoblotting, enzyme-linked immunosorbent assay (ELISA), radioimmunoassay (RIA), immunoprecipitation, immunofluorescence, surface plasmon resonance, chemiluminescence, fluorescent polarization, phosphorescence, immunohistochemical analysis, matrix-assisted laser desorption/ionization time-of-flight (MALDI-TOF) mass spectrometry, liquid chromatography (LC)-mass spectrometry, microcytometry, microscopy, fluorescence activated cell sorting (FACS), and flow cytometry, as well as assays based on a property of a protein including, but not limited to, enzymatic activity or interaction with other protein partners. Methods to measure mRNA levels are known in the art.

"Percent (%) sequence identity" with respect to a reference polynucleotide or polypeptide sequence is defined as the percentage of nucleic acids or amino acids in a candidate sequence that are identical to the nucleic acids or amino acids in the reference polynucleotide or polypeptide sequence, after aligning the sequences and introducing gaps (DNA core sequences), if necessary, to achieve the maximum percent sequence identity. Alignment for purposes of determining percent nucleic acid or amino acid sequence identity can be achieved in various ways that are within the capabilities of one of skill in the art, for example, using publicly available computer software such as BLAST, BLAST-2, or Megalign software. Those skilled in the art can determine appropriate parameters for aligning sequences, including any algorithms needed to achieve maximal alignment over the full length of the sequences being compared. For example, percent sequence identity values can be generated using the sequence comparison computer program BLAST. As an illustration, the percent sequence identity of a given nucleic acid or amino acid sequence, A, to, with, or against a given nucleic acid or amino acid sequence, B, (which can alternatively be phrased as a given nucleic acid or amino acid sequence, A that has a certain percent sequence identity to, with, or against a given nucleic acid or amino acid sequence, B) is calculated as follows:

$$100 \text{ multiplied by (the fraction } X/Y)$$

where X is the number of nucleotides or amino acids scored as identical matches by a sequence alignment program (e.g., BLAST) in that program's alignment of A and B, and where Y is the total number of nucleic acids in B. It will be appreciated that where the length of nucleic acid or amino acid sequence A is not equal to the length of nucleic acid or amino acid sequence B, the percent sequence identity of A to B will not equal the percent sequence identity of B to A.

By 'level' is meant a level or activity of a protein, or mRNA encoding the protein (e.g., MLH3), optionally as compared to a reference. The reference can be any useful reference, as defined herein. By a "decreased level" or an "increased level" of a protein is meant a decrease or increase in protein level, as compared to a reference (e.g., a decrease or an increase by about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 100%, about 150%, about 200%, about 300%, about 400%, about 500%, or more; a decrease or an increase of more than about 10%, about 15%, about 20%, about 50%, about 75%, about 100%, or about 200%, as compared to a reference; a decrease or an increase by less than about 0.01-fold, about 0.02-fold, about 0.1-fold, about 0.3-fold, about 0.5-fold, about 0.8-fold, or less; or an increase by more than about 1.2-fold, about 1.4-fold, about 1.5-fold, about 1.8-fold, about 2.0-fold, about 3.0-fold, about 3.5-fold, about 4.5-fold, about 5.0-fold, about 10-fold, about 15-fold, about 20-fold, about 30-fold, about 40-fold, about 50-fold, about 100-fold, about 1000-fold, or more). A level of a protein can be expressed in mass/vol (e.g., g/dL, mg/mL, μg/mL, or ng/mL) or percentage relative to total protein or mRNA in a sample.

The term "pharmaceutical composition," as used herein, represents a composition containing a compound described herein formulated with a pharmaceutically acceptable excipient, and can be manufactured or sold with the approval of a governmental regulatory agency as part of a therapeutic regimen for the treatment of disease in a mammal. Pharmaceutical compositions can be formulated, for example, for oral administration in unit dosage form (e.g., a tablet, capsule, caplet, gelcap, or syrup), for topical administration (e.g., as a cream, gel, lotion, or ointment); for intravenous administration (e.g., as a sterile solution free of particulate emboli and in a solvent system suitable for intravenous use); for intrathecal injection; for intracerebroventricular injections; for intraparenchymal injection; or in any other pharmaceutically acceptable formulation.

A "pharmaceutically acceptable excipient," as used herein, refers any ingredient other than the compounds described herein (for example, a vehicle capable of suspending or dissolving the active compound) and having the properties of being substantially nontoxic and non-inflammatory in a patient. Excipients can include, for example: antiadherents, antioxidants, binders, coatings, compression aids, disintegrants, dyes (colors), emollients, emulsifiers, fillers (diluents), film formers or coatings, flavors, fragrances, glidants (flow enhancers), lubricants, preservatives, printing inks, sorbents, suspensing or dispersing agents, sweeteners, and waters of hydration. Exemplary excipients include, but are not limited to: butylated hydroxytoluene (BHT), calcium carbonate, calcium phosphate (dibasic), calcium stearate, croscarmellose, crosslinked polyvinyl pyrrolidone, citnc acid, crospovidone, cysteine, ethylcellulose, gelatin, hydroxypropyl cellulose, hydroxypropyl methylcellulose, lactose, magnesium stearate, maltitol, mannitol, methionine, methylcellulose, methyl paraben, microcrystalline cellulose, polyethylene glycol, polyvinyl pyrrolidone, povidone, pregelatinized starch, propyl paraben, retinyl palmitate, shellac, silicon dioxide, sodium carboxymethyl cellulose, sodium citrate, sodium starch glycolate, sorbitol, starch (corn), stearic acid, sucrose, talc, titanium dioxide, vitamin A, vitamin E, vitamin C, and xylitol.

As used herein, the term "pharmaceutically acceptable salt" means any pharmaceutically acceptable salt of the compound of any of the compounds described herein. For example, pharmaceutically acceptable salts of any of the compounds described herein include those that are within the scope of sound medical judgment, suitable for use in contact with the tissues of humans and animals without undue toxicity, irritation, allergic response and are commensurate with a reasonable benefit/risk ratio. Pharmaceutically acceptable salts are well known in the art. For example, pharmaceutically acceptable salts are described in: Berge et al., J. Pharmaceutical Sciences 66:1-19, 1977 and in Pharmaceutical Salts: Properties, Selection, and Use, (Eds. P. H. Stahl and C G. Wermuth), Wiley-VCH, 2008. The salts can be prepared in situ during the final isolation and purification of the compounds described herein or separately by reacting a free base group with a suitable organic acid.

The compounds described herein can have ionizable groups so as to be capable of preparation as pharmaceutically acceptable salts. These salts can be acid addition salts involving inorganic or organic acids or the salts can, in the case of acidic forms of the compounds described herein, be prepared from inorganic or organic bases. Frequently, the compounds are prepared or used as pharmaceutically acceptable salts prepared as addition products of pharmaceutically acceptable acids or bases. Suitable pharmaceutically acceptable acids and bases and methods for preparation of the appropriate salts are well-known in the art. Salts can be prepared from pharmaceutically acceptable non-toxic acids and bases including inorganic and organic acids and bases. Representative acid addition salts include acetate, adipate, alginate, ascorbate, aspartate, benzenesulfonate, benzoate, bisulfate, borate, butyrate, camphorate, camphorsulfonate, citrate, cyclopentanepropionate, digluconate, dodecylsulfate, ethanesulfonate, fumarate, glucoheptonate, glycerophosphate, hemisulfate, heptonate, hexanoate, hydrobromide, hydrochloride, hydroiodide, 2-hydroxy-ethanesulfonate, lactobionate, lactate, laurate, lauryl sulfate, malate, maleate, malonate, methanesulfonate, 2-naphthalenesulfonate, nicotinate, nitrate, oleate, oxalate, palmitate, pamoate, pectinate, persulfate, 3-phenylpropionate, phosphate, picrate, pivalate, propionate, stearate, succinate, sulfate, tartrate, thiocyanate, toluenesulfonate, undecanoate, and valerate salts. Representative alkali or alkaline earth metal salts include sodium, lithium, potassium, calcium, and magnesium, as well as nontoxic ammonium, quaternary ammonium, and amine cations, including, but not limited to ammonium, tetramethylammonium, tetraethylammonium, methylamine, dimethylamine, trimethylamine, triethylamine, and ethylamine.

By a "reference" is meant any useful reference used to compare protein or mRNA levels or activity. The reference can be any sample, standard, standard curve, or level that is used for comparison purposes. The reference can be a normal reference sample or a reference standard or level. A "reference sample" can be, for example, a control, e.g., a predetermined negative control value such as a "normal control" or a prior sample taken from the same subject; a sample from a normal healthy subject, such as a normal cell or normal tissue; a sample (e.g., a cell or tissue) from a subject not having a disease; a sample from a subject that is diagnosed with a disease, but not yet treated with a compound described herein; a sample from a subject that has been treated by a compound described herein; or a sample of a purified protein (e.g., any described herein) at a known normal concentration. By "reference standard or level" is meant a value or number derived from a reference sample. A "normal control value" is a pre-determined value indicative of non-disease state, e.g., a value expected in a healthy control subject. Typically, a normal control value is expressed as a range ("between X and Y"), a high threshold ("no higher than X"), or a low threshold ("no lower than X"). A subject having a measured value within the normal control value for a particular biomarker is typically referred to as "within normal limits" for that biomarker. A normal reference standard or level can be a value or number derived from a normal subject not having a disease or disorder (e.g., a trinucleotide repeat expansion disorder); a subject that has been treated with a compound described herein. In some aspects, the reference sample, standard, or level is matched to the sample subject sample by at least one of the following criteria, age, weight, sex, disease stage, and overall health. A standard curve of levels of a purified protein, e.g., any described herein, within the normal reference range can be used as a reference.

As used herein, the term "subject" refers to any organism to which a composition can be administered, e.g., for experimental, diagnostic, prophylactic, and/or therapeutic purposes Typical subjects include any animal (e.g., mammals such as mice, rats, rabbits, non-human primates, and humans) A subject can seek or be in need of treatment, require treatment, be receiving treatment, be receiving treatment in the future, or be a human or animal who is under care by a trained professional for a particular disease or condition.

As used herein, the terms "treat," "treated," and "treating" mean both therapeutic treatment and prophylactic or preventative measures wherein the object is to prevent or slow down (lessen) an undesired physiological condition, disorder, or disease, or obtain beneficial or desired clinical results. Beneficial or desired clinical results include, but are not limited to, alleviation of symptoms; diminishment of the extent of a condition, disorder, or disease; stabilized (i.e., not worsening) state of condition, disorder, or disease; delay in onset or slowing of condition, disorder, or disease progression; amelioration of the condition, disorder, or disease state or remission (whether partial or total), whether detectable or undetectable; an amelioration of at least one measurable physical parameter, not necessarily discernible by the patient; or enhancement or improvement of condition, disorder, or disease. Treatment includes eliciting a clinically significant response without excessive levels of side effects Treatment also includes prolonging survival as compared to expected survival if not receiving treatment.

As used herein, the terms "variant" and "derivative" are used interchangeably and refer to naturally-occurring, synthetic, and semi-synthetic analogues of a compound, peptide, protein, or other substance described herein. A variant or derivative of a compound, peptide, protein, or other substance described herein can retain or improve upon the biological activity of the original material.

The details of one or more aspects are set forth in the description below. Other features, objects, and advantages will be apparent from the description and from the claims.

DETAILED DESCRIPTION

Figure 1:
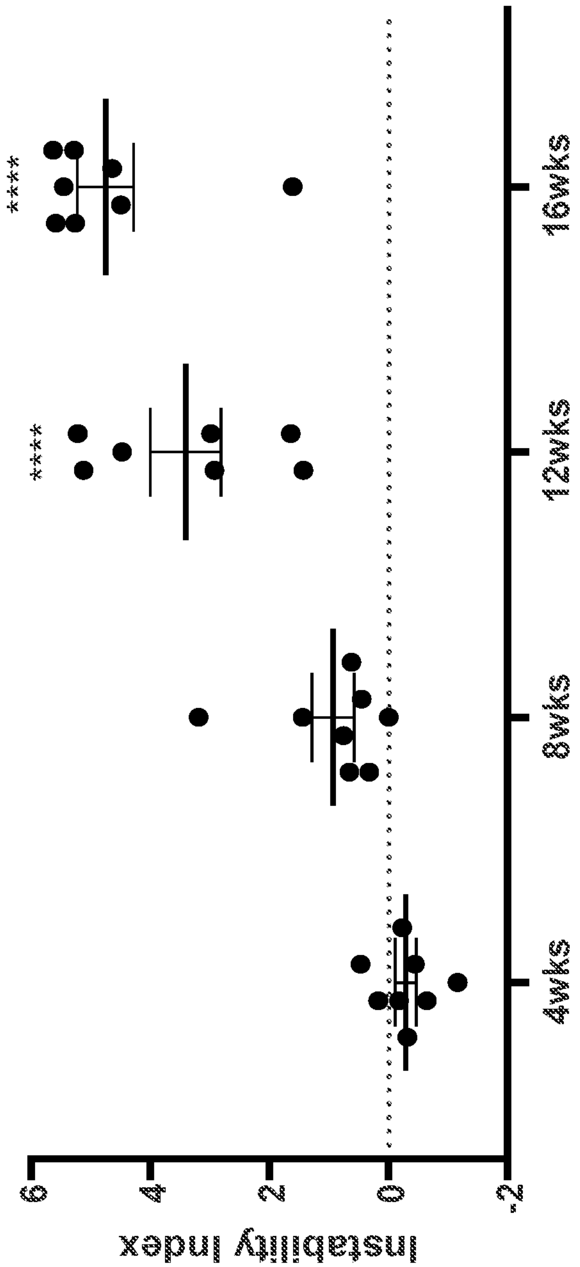
FIG. 1 is a distribution plot showing the somatic expansion of a human HTT transgene in the striatum as measured by the instability index in R6/2 mice at 4, 8, 12, and 16 weeks of age (4 male and 4 female per age group).The bars are mean values and error bars indicate standard deviation.

The present inventors have found that inhibition or depletion of MLH3 level and/or activity in a cell is effective in the treatment of a trinucleotide repeat expansion disorder. Accordingly, useful compositions and methods to treat triucleotide repeat expansion disorders, e.g., in a subject in need thereof are provided herein.

I. Trinuleotide Repeat Expansion Disorders.

Trinucleotide repeat expansion disorders are a family of genetic disorders characterized by the pathogenic expansion of a repeat region within a genomic region. In such disorders, the number of repeats exceeds that of a gene's normal, stable threshold, expanding into a diseased range.

Trinucleotide repeat expansion disorders generally can be categorized as "polyglutamine" or "non-polyglutamine." Polyglutamine disorders, including Huntington's disease (HD) and several spinocerebellar ataxias, are caused by a CAG (glutamine) repeats in the protein-coding regions of specific genes. Non-polyglutamine disorders are more heterogeneous and can be caused by CAG trinucleotide repeat expansions in non-coding regions, as in Myotonic dystrophy, or by the expansion of trinucleotide repeats other than CAG that can be in coding or non-coding regions such as the CGG repeat expansion responsible for Fragile X Syndrome.

Trinucleotide repeat expansion disorders are dynamic in the sense that the number of repeats can vary from generation-to-generation, or even from cell-to-cell in the same individual. Repeat expansion is believed to be caused by polymerase "slipping" during DNA replication. Tandem repeats in the DNA sequence can "loop out" while maintaining complementary base pairing between the parent strand and daughter strands. If the loop structure is formed from the daughter strand, the number of repeats will increase.

Conversely, if the loop structure is formed from the parent strand, the number of repeats will decrease. It appears that expansion is more common than reduction. In general, the length of repeat expansion is negatively correlated with prognosis longer repeats are correlated with an earlier age of onset and worsened disease severity. Thus, trinucleotide repeat expansion disorders are subject to .anticipation," meaning the severity of symptoms and/or age of onset worsen through successive generations of affected families due to the expansion of these repeats from one generation to the next.

Trinucleotide repeat expansion disorders are well known in the art. Exemplary trinucleotide repeat expansion disorders and the trinucleotide repeats of the genes commonly associated with them are included in Table 1.

TABLE 1

Exemplary Trinucleotide Repeat Expansion Disorders

| Disease | Gene | Nucleotide Repeat |
|---|---|---|
| ARX-nonsyndromic X-linked mental retardation (XLMR) | ARX | GCG |
| Baratela-Scott Syndrome | XYLT1 | GGC |
| Blepharophimosis/Ptosis/Epicanthus inversus syndrome type II | FOXL2 | GCG |
| Cleidocranial dysplasia (CCD) | RUNX2 | GCG |
| Congenital central hypoventilation | PHOX-2B | GCG |
| Congenital central hypoventilation syndrome (CCHS) | PHOX2B | GCG |
| Creutzfeldt-Jakob disease | PRNP | |
| Dentatorubral-pallidoluysian atrophy (DRPLA)/Haw River syndrome | ATN1 | CAG |
| Early infantile epileptic encephalopathy (Ohtahara syndrome) | ARX | GCG |
| FRA2A syndrome | AFF3 | CGC |
| FRA7A syndrome | ZNF713 | CGG |
| Fragile X mental retardation (FRAX-E) | AFF2/FMR2 | GCC |
| Fragile X Syndrome (FXS) | FMR1 | CGG |
| Fragile X-associated Primary Ovarian Insufficiency (FXPOI) | FMR1 | CGG |
| Fragile X-associated Tremor Ataxia Syndrome (FXTAS) | FMR1 | CGG |
| Friedreich ataxia (FRDA) | FXN | GAA |
| Fuchs' Corneal Endothelial Dystrophy (FECD) | TCF4 | CTG |
| Hand-foot genital syndrome (HFGS) | HOXA13 | GCG |
| Holoprosencephaly disorder (HPE) | ZIC2 | GCG |
| Huntington disease-like 2 (HDL2) | JPH3 | CTG |
| Huntington's Disease (HD) | HTT | CAG |
| Infantile spasm syndrome/West syndrome (ISS) | ARX | GCG |
| Jacobsen syndrome | | |
| KCNN3-associated (e.g., schizophrenia) | KCNN3 | CAG |
| Multiple Skeletal dysplasias | COMP | GAC |
| Myotonic Dystrophy type 1 (DM1) | DMPK | CTG |
| Myotonic Dystrophy type 2 (DM2) | CNBP | CCTG |
| NCOA3-associated (e.g., increased risk of prostate cancer) | NCOA3 | CAG |

TABLE 1-continued

Exemplary Trinucleotide Repeat Expansion Disorders

| Disease | Gene | Nucleotide Repeat |
|---|---|---|
| Neuronal intranuclear inclusion disease (NIID) | NOTCH2NLC | GGC |
| Oculopharyngeal Muscular Dystrophy (OPMD) | PABPN1 | GCG |
| Spastic ataxia - Charlevoix-Saguenay | | |
| Spinal Muscular Bulbar Atrophy (SMBA) | AR | CAG |
| Spinocerebellar ataxia type 1 (SCA1) | ATXN1 | CAG |
| Spinocerebellar ataxia type 10 (SCA10) | ATXN10 | ATTCT |
| Spinocerebellar ataxia type 12 (SCA12) | PPP2R2B | CAG |
| Spinocerebellar ataxia type 17 (SCA17) | TBP/ATXN17 | CAG |
| Spinocerebellar ataxia type 2 (SCA2) | ATXN2 | CAG |
| Spinocerebellar ataxia type 3 (SCA3)/Machado-Joseph Disease | ATXN3 | CAG |
| Spinocerebellar ataxia type 45 (SCA45) | FAT2 | CAG |
| Spinocerebellar ataxia type 6 (SCA6) | CACNA1A | CAG |
| Spinocerebellar ataxia type 7 (SCA7) | ATXN7 | CAG |
| Spinocerebellar ataxia type 8 (SCA8) | ATXN8 | CTG |
| Syndromic neurodevelopmental disorder with cerebellar, ocular, craniofacial, and genital features (COFG syndrome) | MAB21L1 | CAG |
| Synpolydactyly (SPD I) | HOXD13 | GCG |
| Synpolydactyly (SPD II) | HOXD12 | GCG |

The proteins associated With trinucleotide repeat expansion disorders are typically selected based on an experimental association of the protein associated with a trinucleotide repeat expansion disorder to a trinucleotide repeat expansion disorder. For example, the production rate or circulating concentration of a protein associated with a trinucleotide repeat expansion disorder can be elevated or depressed in a population having at ninucleotide repeat expansion disorder relative to a population lacking the trinucleotide repeat expansion disorder. Differences in protein levels can be assessed using proteomic techniques including but not limited to Western blot, immunohistochemical staining, enzyme linked immunosorbent assay (ELISA), and mass spectrometry. Alternatively, the proteins associated with trinucleotide repeat expansion disorders can be identified by obtaining gene expression profiles of the genes encoding the proteins using genomic techniques including, but not limited to, DNA microarray analysis, serial analysis of gene expression (SAGE), and quantitative real-time polymerase chain reaction (qPCR).

II. Evidence tor the Involvement of Mismatch Repair Pathway in Trinucleotide Repeat Expansion There is growing evidence that DNA repair pathways, particularly mismatch repair (MMR), are involved in the expansion of trinucleotide repeats. A recent genome-wide association (GWA) analysis led to the identification of loci harboring genetic variations that alter the age at neurological onset of Huntington's disease (HD) (GEM-HD Consortium, Cell. 2015 Jul. 30; 162(3):516-26) The study identified MLH1, the human homolog of the *E. coli* DNA mismatch repair gene mutL A subsequent GWA study in polyglutamine disease patients found significant association of age at onset when grouping all polyglutamine diseases (HD and SCAs) with DNA repair genes as a group, as well as significant associations for specific SNPs in FAN1 and PMS2 with the diseases (Bettencourt et al., (2016) Ann. Neurol., 79: 983-990). These results were consistent with those from an earlier study comparing differences in repeat expansion in two different mouse models of Huntington's Disease, which identified Mlh1 and Mlh3 as novel critical modifiers of CAG instability (Pinto et al., (2013) Mismatch Repair Genes Mih1 and Mlh3 Modify CAG Instability in Huntington's Disease Mice: Genome-Wide and Candidate Approaches. PLoS Genet 9(10). e1003930). Another member of the mismatch repair pathway, 8-oxo-guanine glycosylase (OGG1) has also been implicated in expansion, as somatic expansion was found to be reduced in transgenic mice lacking OGG1 (Kovtun 1. V. et al. (2007) Nature 447, 447-452). However, another study found that human subjects containing a Ser326Cys polymorphism in hOGG1, which results in reduced OGG1 activity, results in increased mutant huntingtin (Coppede et al., (2009) Toxicol., 278: 199-203). Likewise, complete inactivation of Fan1, another component of the DNA repair pathway, in a mouse HD model produces somatic CAG expansions (Long et al. (2018) J. Hum Genet., 103: 1-9). MSH3, another component of the mismatch repair pathway, has been reported to be linked to somatic expansion: polymorphisms in Msh3 was associated with somatic instability of the expanded CTG trinucleotide repeat in myotonic dystrophy type 1 (DM1) patients (Morales et al., (2016) DNA Repair 40: 57-66). Furthermore, natural polymorphisms in Msh3 and Mih1 have been revealed as mediators of mouse strain specific differences in CTG•CAG repeat instability (Pinto et al. (2013) ibid; Tome et al., (2013) PLoS Genet 9 e1003280). Further evidence of Msh2 and Msh3's involvement in expansion repeats was reported in a study in which short hairpin RNA (shRNA) knockdown of either MSH2 or MSH3 slowed, and ectopic expression of either MSH2 or MSH3 induced GAA trinucleotide repeat expansion of the Friedreich Ataxia (FRDA) gene in fibroblasts derived from FRDA patients (Halabi et al., (2012) J. Biol Chem. 287, 29958-29967). In spite of some inconsistent results provided above, there is strong evidence that the MMR pathway plays some role in the expansion of trinucleotide repeats in various disorders. Moreover, they are the first to recognize that the inhibition of the MMR pathway provides for the treatment or prevention of these repeat expansion disorders; however, no therapy is currently available or in development which modulates MMR for purposes of treating or preventing these repeat expansion disorders.

III. Olgonucleotde Agents

Agents described herein that reduce the level and/or activity of MLH3 in a cell can be, for example, a polynucleotide, e.g., an oligonucleotide. These agents reduce the level of an activity related to MLH3, or a related downstream effect, or reduce the level of MLH3 in a cell or subject.

In some aspects, the agent that reduces the level and/or activity of MLH3 is a polynucleotide. In some aspects, the polynucleotide is a single-stranded oligonucleotide, e.g., that acts by way of an RNase H-mediated pathway. Oligonucleotides include DNA and DNA/RNA chimeric molecules, typically about 10 to 30 nucleotides in length, which recognize polynucleotide target sequences or sequence portions through hydrogen bonding interactions with the nucleotide bases of the target sequence (e.g., MLH3). An oligonucleotide molecule can decrease the expression level (e.g., protein level or mRNA level) of MLH3. For example, an oligonucleotide includes oligonucleotides that targets full-length MLH3. In some aspects, the oligonucleotide molecule recruits an RNase H enzyme, leading to target mRNA degradation.

In some aspects, the oligonucleotide decreases the level and/or activity of a positive regulator of function. In other aspects, the oligonucleotide increases the level and/or activity of an inhibitor of a positive regulator of function. In some aspects, the oligonucleotide increases the level and/or activity of a negative regulator of function.

In some aspects, the oligonucleotide decreases the level and/or activity or function of MLH3. In some aspects, the oligonucleotide inhibits expression of MLH3. In other aspects, the oligonucleotide increases degradation of MLH3 and/or decreases the stability (i.e., half-life) of MLH3. The oligonucleotide can be chemically synthesized.

The oligonucleotide includes an oligonucleotide having a region of complementarity (e.g., a contiguous nucleobase region) which is complementary to at least a part of an mRNA formed in the expression of a MLH3 gene. The region of complementarity can be about 30 nucleotides or less in length (e.g., about 30, 29, 28, 27, 26, 25, 24, 23, 22, 21, 20, 19, or 18 nucleotides or less in length). Upon contact with a cell expressing the MLH3 gene, the oligonucleotide can inhibit the expression of the MLH3 gene (e.g., a human, a primate, a non-primate, or a bird MLH3 gene) by at least about 10% as assayed by, for example, a PCR or branched DNA (bDNA)-based method, or by a protein-based method, such as by immunofluorescence analysis, using, for example, Western Blotting or flowcytometric techniques.

Similarly, the region of complementarity to the target sequence can be between 10 and 30 linked nucleosides in length, e.g., 10, 11, 12, 13, 14, 15, 16, 17, 18, 19, 20, 21, 22, 23, 24, 25, 26, 27, 28, 29, or 30 or between 10-29, 10-28, 10-27, 10-26, 10-25, 10-24, 10-23, 10-22, 10-21, 10-20, 10-19, 10-18,10-17, 10-16, 10-15, 10-14,10-13, 10-12, 15-29, 15-28, 15-27, 15-26,15-25, 15-24, 15-23, 15-22, 15-21, 15-20,15-19, 15-18, 15-17, 18-30, 18-29, 18-28, 18-27, 18-26, 18-25,18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24,20-23, 20-22, 20-21, 21-30, 21-29, 21-28, 21-27, 21-26, 21-25, 21-24, 21-23, or 21-22 linked nucleosides in length. Ranges and lengths intermediate to the above recited ranges and lengths are also contemplated.

An oligonucleotide can be synthesized by standard methods known in the art as further discussed below, e.g., by use of an automated DNA synthesizer, such as are commercially available from, for example, Biosearch, Applied Biosystems, Inc.

The oligonucleotide compound can be prepared using solution-phase or solid-phase organic synthesis or both. Organic synthesis offers the advantage that the oligonucleotide comprising unnatural or alternative nucleotides can be easily prepared. Single-stranded oligonucleotides can be prepared using solution-phase or solid-phase organic synthesis or both.

In one aspect, an oligonucleotide described herein includes a region of at least 10 contiguous nucleobases having at least 80% (e.g., at least 85%, at least 90%, at least 95%, or at least 99%) complementary to at least 10 contiguous nucleotides of a MLH3 gene. In some aspects, the oligonucleotide comprises a sequence complementary to at least 17 contiguous nucleotides, 19-23 contiguous nucleotides, 19 contiguous nucleotides, or 20 contiguous nucleotides of a MLH3 gene. The oligonucleotide sequence can be selected from the group of sequences provided in any one of SEQ ID NOs. 6-4710.

In one aspect, the sequence is substantially complementary to a sequence of an mRNA generated in the expression of a MLH3 gene. In some aspects, the region of at least 10 nucleobases is complementary to an MLH3 gene corresponding to a sequence of reference mRNA NM_001040108.1 at one or more of positions 221-293, 321-506, 534-576, 584-636, 681-740, 818-878, 952-1024, 1129-1158, 1177-1264, 1287-1318, 1351-1378, 1536-1598, 1623-1660, 1739-1764, 1782-1823, 1847-1908, 2026-2051, 2063-2094, 2115-2146, 2256-2290, 2387-2414, 2421-2592, 2727-2788, 2826-2937, 3005-3043, 3078-3107, 3159-3185, 3214-3239, 3244-3272, 3282-3308, 3426-3483, 3561-3587, 3642-3769, 3804-3839, 3950-3977, 4004-4040, 4052-4115, 4139-4199, 4241-4301, 4328-4365, 4420-4448, 4472-4536, 4669-4708, and 4784-4810 of the MLH3 gene. In some aspects, the region of at least 10 nucleobases is complementary to an MLH3 gene corresponding to a sequence of reference mRNA NM_001040108.1 at one or more of positions 221-293, 321-506, 534-576, 584-636, 681-740, 818-878, 952-1024, 1129-1158, 1177-1264, 1287-1318, 1351-1378, 1568-1598,1623-1660, 1782-1823,1870-1904, 2063-2094, 2115-2146, 2256-2287, 2387-2414, 2422-2592, 2727-2788, 2826-2937, 3009-3043, 3078-3107, 3159-3185, 3214-3272, 3282-3307, 3426-3483, 3561-3587, 3642-3767, 3804-3839, 3950-3977, 4004-4039, 4052-4115, 4139-4199, 4241-4301, 4329-4365, 4420-4448, 4472-4536, 4680-4708, and 4784-4810 of the MLH3 gene. In some aspects, the region of at least 10 nucleobases is complementary to an MLH3 gene corresponding to a sequence of reference mRNA NM_001040108.1 at one or more of positions 221-293, 321-506, 534-635, 681-740, 842-875, 953-1024, 1129-1158, 1179-1264, 1287-1316, 1351-1378, 1568-1598, 1623-1659, 1782-1823, 1870-1904, 2064-2091, 2115-2146, 2256-2287, 2387-2414, 2422-2592, 2727-2788, 2829-2937, 3010-3043, 3079-3107, 3159-3185, 3246-3271, 3282-3307, 3426-3474, 3561-3587, 3642-3707, 3804-3839, 3950-3977, 4004-4039, 4052-4114, 4139-4164, 4174-4199, 4241-4288, 4329-4365, 4421-4448, 4472-4536, 4680-4708, and 4784-4810 of the MLH3 gene. In some aspects, the region of at least 10 nucleobases is complementary to an MLH3 gene corresponding to a sequence of reference mRNA NM_001040108.1 at one or more of positions 331-362, 393-438, 479-505, 534-574, 587-612, 681-740, 847-873, 991-1024, 1210-1262, 1351-1378, 1571-1597, 1623-1648, 1874-1902, 2066-2091, 2256-2281, 2388-2414, 2470-2515, 2732-2788, 2853-2878, 2901-2927, 3282-3307, 3562-3587, 4056-4083, 4241-4266, and 4506-4531 of the MLH3 gene. In some aspects, the region of at least 10 nucleobases is complementary to an MLH3 gene corresponding to a sequence of reference mRNA NM_001040108.1 at one or more of positions 335-449, 587-612, 682-736, 848-873, 991-1016, 1179-1204, 1233-1260, 1351-1378, 1626-1651, 1874-1903, 2066-2091, 2115-2146, 2256-2287, 2389-2414, 2471-2499, 2762-2787, 2853-2878, 2911-2936, 3562-3587, 3814-3839, 4006-4031, 4056-4083, and 4244-4269 of the MLH3 gene. In some aspects, the region of at least 10 nucleobases is complementary to an MLH3 gene corresponding to a sequence of reference mRNA NM_001040108.1 at one or more of positions 355-393, 952-984, 1177-1205, 2026-2052, 2066-2094, 2470-2498, 3159-3185, 3458-3485, and 4259-4292 of the MLH3 gene.

In some aspects, the oligonucleotide comprises the nucleobase sequence of any one of SEQ ID NOs: 6-4710. In some aspects, the oligonucleotide comprises the nucleobase sequence of any one of SEQ ID NOs: 89, 92, 102, 107-108, 110-111, 115-116, 150, 154, 160-161, 163-164, 166, 168, 175-176, 178, 180, 182-183, 185-189, 201, 211-212, 229-231, 234-238, 241, 248-250, 254, 265-269, 282-283, 285-288, 294, 296, 319-322, 328-329, 366-368, 377-379, 381-399, 487-488, 511, 514-517, 520, 566-568, 573, 591, 593-594, 599, 602, 666, 669-670, 701-704, 728, 749-753, 755, 757, 784, 786-788, 790, 828-830, 959, 972, 974-977, 1002, 1004-1005, 1007, 1009-1013, 1086, 1110-1111, 1126, 1149, 1172, 1176-1181, 1185, 1260, 1271-1274, 1276-1277, 1297, 1302, 1387-1390, 1392-1393, 1396, 1461-1463, 1473-1474, 1482, 1490-1491, 1495, 1498-1502, 1505, 1508, 1510-1514, 1516-1518, 1525-1526, 1529-1530, 1546-1547, 1572, 1596-1597, 1721-1722, 1724-1727, 1744-1746, 1797, 1800-1802, 1824-1826, 1832, 1835-1836, 1859, 1865-1866, 1870-1873, 1875, 1878, 1880-1882, 1911, 1914-1918, 1924, 1945-1946, 1949, 2000-2001, 2035, 2064, 2066-2067, 2090-2091, 2163, 2166, 2169-2172, 2178, 2181, 2184, 2186, 2194, 2255-2256, 2307, 2321, 2333, 2343, 2345-2346, 2353-2355, 2394-2395, 2403-2404, 2460-2462, 2489-2492, 2495, 2499-2500, 2524-2530, 2561-2562, 2591, 2595, 2616, 2644-2651, 2653-2654, 2661-2664, 2674, 2683-2685, 2687, 2690-2691, 2693-2695, 2725-2728, 2777-2782, 2784-2785, 2789, 2791-2792, 2794-2795, 2797, 2848-2852, and 2917-2918. In some aspects, the oligonucleotide comprises the nucleobase sequence of any one of SEQ ID NOs: 89, 92, 102, 107-108, 111, 116, 150, 154, 160-161, 163-164, 166, 168, 175-176, 178, 180, 182-183, 185-189, 201, 211-212, 229-231, 234-236, 238, 241, 248-250, 254, 265-269, 282-283, 285-288, 294, 296, 319-320, 322, 328-329, 366-368, 377, 379, 381-399, 487-488, 511, 514-517, 520, 566-568, 573, 591, 593-594, 599, 602, 666, 669-670, 701-704, 728, 750-753, 755, 757, 784, 786-788, 790, 828-830, 972, 974-977, 1002, 1004-1005, 1009-1013, 1110-1111, 1126, 1172, 1176-1181, 1271-1274, 1276-1277, 1297, 1302, 1387, 1390, 1392-1393, 1461-1463, 1474, 1482, 1490-1491, 1498-1502, 1505, 1508, 1510-1512, 1514, 1516-1518,1525-1526, 1529-1530, 1546-1547, 1572, 1597, 1721-1722, 1724-1727, 1744-1746, 1797, 1800-1801, 1824-1826, 1832, 1835-1836, 1859, 1866, 1870-1873, 1878, 1880-1882, 1915-1917, 1924, 1945-1946, 1949, 2000-2001, 2035, 2064, 2066-2067, 2090, 2163, 2166, 2169-2172, 2178, 2181, 2184, 2186, 2194, 2255-2256, 2307, 2321, 2333, 2343, 2345, 2353, 2394-2395, 2403-2404, 2460-2462, 2489, 2491-2492, 2495, 2499, 2524-2525, 2527-2530, 2561-2562, 2591, 2595, 2616, 2644-2651, 2653-2654, 2661-2664, 2674, 2684, 2693-2695, 2725-2728, 2777-2782, 2784-2785, 2789, 2791-2792, 2794-2795, 2797, 2849-2852, and 2917-2918. In some aspects, the oligonucleotide comprises the nucleobase sequence of any one of SEQ ID NOs: 89, 102, 111, 116, 150, 154, 160-161, 163-164, 166, 168, 175-176, 178, 180, 183, 185-189, 201, 211-212, 229-231, 235-236, 238, 241, 250, 254, 265-269, 282-283, 286-288, 294, 296, 319, 322, 328, 366-368, 377, 379, 381-399, 511, 514-517, 567-568, 591, 593-594, 599, 602, 666, 669-670, 703, 728, 750-753, 755, 757, 784, 786-788, 828-830, 972, 974-977, 1002, 1004-1005, 1009, 1011-1012, 1110-1111, 1126, 1172, 1176-1181, 1272-1274, 1297, 1302, 1387, 1392-1393, 1461-1463, 1474, 1482, 1498-1500, 1502, 1505, 1508, 1510-1511, 1514, 1516-1518, 1525-1526, 1529-1530, 1546-1547, 1572, 1597, 1721-1722, 1725-1727, 1745-1746, 1800-1801, 1824, 1832, 1835-1836, 1859, 1866, 1870-1872, 1878, 1880-1882, 1916, 1924, 1946, 1949, 2000-2001, 2066, 2090, 2163, 2169-2171, 2178, 2181, 2186, 2255-2256, 2307, 2321, 2333, 2394, 2403-2404, 2460-2462, 2489, 2491-2492, 2495, 2499, 2524-2525, 2527-2530, 2561, 2591, 2616, 2644, 2646, 2649-2651, 2653-2654, 2661-2664, 2684, 2693-2695, 2726-2728, 2777-2780, 2782, 2784-2785, 2791-2792, 2794-2795, 2797, 2849-2850, 2852, and 2917-2918. In some aspects, the oligonucleotide comprises the nucleobase sequence of any one of SEQ ID NOs: 160-161, 163-164, 166, 211-212, 230-231, 267-268, 282, 294, 322, 366-367, 391-394, 399, 514-515, 594, 602, 728, 750, 752-753, 755, 828, 830, 975-976, 1002, 1176-1179, 1274, 1387, 1462-1463, 1510, 1514, 1529-1530, 1726-1727, 1745-1746, 1824, 1871-1872, 2090, 2256, 2528-2530, 2644, and 2792 In some aspects, the oligonucleotide comprises the nucleobase sequence of any one of SEQ ID NOs: 164, 186-187, 212, 235, 322, 367-368, 379, 384-385, 388-389, 391-392, 395, 515, 594, 703, 751-753, 828-830, 1005, 1176-1180, 1274, 1297, 1302, 1387, 1393, 1463, 1511, 1514, 1745, 1824, 1881, 2256, 2404, 2491, 2528, 2530, and 2646. In some aspects, the oligonucleotide comprises the nucleobase sequence of any one of SEQ ID NOs: 174-176, 178, 180-187, 566-569, 573, 701-704, 1260-1261, 1274-1277, 1510-1513, 2000-2001, 2194, 2196, 2661-2664, and 2666.

In some aspects, the nucleobase sequence of the oligonucleotide consists of any one of SEQ ID NOs: 6-4710. In some aspects, the oligonucleotide consists of the nucleobase sequence of any one of SEQ ID NOs: 89, 92, 102, 107-108, 110-111, 115-116, 150, 154, 160-161, 163-164, 166, 168, 175-176, 178, 180, 182-183, 185-189, 201, 211-212, 229-231, 234-238, 241, 248-250, 254, 265-269, 282-283, 285-288, 294, 296, 319-322, 328-329, 366-367-368, 377-379, 381-399, 487-488, 511, 514-517, 520, 566-568, 573, 591, 593-594, 599, 602, 666, 669-670, 701-704, 728, 749-753, 755, 757, 784, 786-788, 790, 828-830, 959, 972, 974-977, 1002, 1004-1005, 1007, 1009-1013, 1086, 1110-1111, 1126, 1149, 1172, 1176-1181, 1185, 1260, 1271-1274, 1276-1277, 1297, 1302, 1387-1390, 1392-1393, 1396, 1461-1463, 1473-1474, 1482, 1490-1491, 1495, 1498-1502, 1505, 1508, 1510-1514, 1516-1518, 1525-1526, 1529-1530, 1546-1547, 1572, 1596-1597, 1721-1722, 1724-1725-1726-1727, 1744-1746, 1797, 1800-1802, 1824-1826, 1832, 1835-1836, 1859, 1865-1866, 1870-1873, 1875, 1878, 1880-1882, 1911, 1914-1918, 1924, 1945-1946, 1949, 2000-2001, 2035, 2064, 2066-2067, 2090-2091, 2163, 2166, 2169-2172, 2178, 2181, 2184, 2186, 2194, 2255-2256, 2307, 2321, 2333, 2343, 2345-2346, 2353-2355, 2394-2395, 2403-2404, 2460-2462, 2489-2492, 2495, 2499-2500, 2524-2530, 2561-2562, 2591, 2595, 2616, 2644-2651, 2653-2654, 2661-2664, 2674, 2683-2685, 2687, 2690-2691, 2693-2695, 2725-2728, 2777-2782, 2784-2785, 2789, 2791-2792, 2794-2795, 2797, 2848-2852, and 2917-2918. In some aspects, the oligonucleotide consists of the nucleobase sequence of any one of SEQ ID NOs: 89, 92, 102, 107-108, 111, 116, 150, 154, 160-161, 163-164, 166, 168, 175-176, 178, 180, 182-183, 185-189, 201, 211-212, 229-231, 234-236, 238, 241, 248-250, 254, 265-269, 282-283, 285-288, 294, 296, 319-320, 322, 328-329, 366-368, 377, 379, 381-399, 487-488, 511, 514-517, 520, 566-568, 573, 591, 593-594, 599, 602, 666, 669-670, 701-704, 728, 750-753, 755, 757, 784, 786-788, 790, 828-830, 972, 974-977, 1002, 1004-1005, 1009-1013, 1110-

1111, 1126, 1172, 1176-1181, 1271-1274, 1276-1277, 1297, 1302, 1387, 1390, 1392-1393, 1461-1462-1463, 1474, 1482, 1490-1491, 1498-1502, 1505, 1508, 1510-1512, 1514, 1516-1518, 1525-1526,1529-1530, 1546-1547, 1572, 1597, 1721-1722, 1724-1727, 1744-1746, 1797, 1800-1801, 1824-1826, 1832, 1835-1836, 1859, 1866, 1870-1873, 1878, 1880-1882, 1915-1917, 1924, 1945-1946, 1949, 2000-2001, 2035, 2064, 2066-2067, 2090, 2163, 2166, 2169-2172, 2178, 2181, 2184, 2186, 2194, 2255-2256, 2307, 2321, 2333, 2343, 2345, 2353, 2394-2395, 2403-2404, 2460-2462, 2489, 2491-2492, 2495, 2499, 2524-2525, 2527-2530, 2561-2562, 2591, 2595, 2616, 2644-2651, 2653-2654, 2661-2664, 2674, 2684, 2693-2695, 2725-2728, 2777-2782, 2784-2785, 2789, 2791-2792, 2794-2795, 2797, 2849-2852, and 2917-2918. In some aspects, the oligonucleotide consists of the nucleobase sequence of any one of SEQ ID NOs: 89, 102, 111, 116, 150, 154, 160-161, 163-164, 166, 168, 175-176, 178, 180, 183, 185-189, 201, 211-212, 229-231, 235-236, 238, 241, 250, 254, 265-269, 282-283, 286-288, 294, 296, 319, 322, 328, 366-368, 377, 379, 381-399, 511, 514-517, 567-568, 591, 593-594, 599, 602, 666, 669-670, 703, 728, 750-753, 755, 757, 784, 786-788, 828-830, 972, 974-977, 1002, 1004-1005, 1009, 1011-1012, 1110-1111, 1126, 1172, 1176-1181, 1272-1274, 1297, 1302, 1387, 1392-1393, 1461-1463, 1474, 1482, 1498-1500, 1502, 1505, 1508, 1510-1511, 1514, 1516-1518, 1525-1526, 1529-1530, 1546-1547, 1572, 1597, 1721-1722, 1725-1727, 1745-1746, 1800-1801, 1824, 1832, 1835-1836, 1859, 1866, 1870-1872, 1878, 1880-1882, 1916, 1924, 1946, 1949, 2000-2001, 2066, 2090, 2163, 2169-2171, 2178, 2181, 2186, 2255-2256, 2307, 2321, 2333, 2394, 2403-2404, 2460-2462, 2489, 2491-2492, 2495, 2499, 2524-2525, 2527-2530, 2561, 2591, 2616, 2644, 2646, 2649-2651, 2653-2654, 2661-2664, 2684, 2693-2695, 2726-2728, 2777-2780, 2782, 2784-2785, 2791-2792, 2794-2795, 2797, 2849-2850, 2852, and 2917-2918. In some aspects, the oligonucleotide consists of the nucleobase sequence of any one of SEQ ID NOs. 160-161, 163-164, 166, 211-212, 230-231, 267-268, 282, 294, 322, 366-367, 391-394, 399, 514-515, 594, 602, 728, 750, 752-753, 755, 828, 830, 975-976, 1002, 1176-1179, 1274, 1387, 1462-1463, 1510, 1514, 1529-1530, 1726-1727, 1745-1746, 1824, 1871-1872, 2090, 2256, 2528-2530, 2644, and 2792. In some aspects, the oligonucleotide consists of the nucleobase sequence of any one of SEQ ID NOs: 164,186-187, 212, 235, 322, 367-368, 379, 384-385, 388-389, 391-392, 395, 515, 594, 703, 751-753, 828-830, 1005, 1176-1180, 1274, 1297, 1302, 1387, 1393, 1463, 1511, 1514, 1745, 1824, 1881, 2256, 2404, 2491, 2528, 2530, and 2646. In some aspects, the oligonucleotide consists of the nucleobase sequence of any one of SEQ ID NOs: 174-176, 178, 180-187, 566-569, 573, 701-704, 1260-1261, 1274-1277,1510-1513, 2000-2001, 2194, 2196, 2661-2664, and 2666. In some aspects. In some aspects, the oligonucleotide exhibits at least 50% mRNA inhibition at 20 nM oligonucleotide concentration when determined using a cell assay when compared with a control cell.

In some aspects, the oligonucleotide exhibits at least 60% mRNA inhibition at a 20 nM oligonucleotide concentration when determined using a cell assay when compared with a control cell. In some aspects, the oligonucleotide exhibits at least 70% mRNA inhibition at a 20 nM oligonucleotide concentration when determined using a cell assay when compared with a control cell. In some aspects, the oligonucleotide exhibits at least 85% mRNA inhibition at a 20 nM oligonucleotide concentration when determined using a cell assay when compared with a control cell. In some aspects, the oligonucleotide exhibits at least 50% mRNA inhibition at a 2 nM oligonucleotide concentration when determined using a cell assay when compared with a control cell. In some aspects, the oligonucleotide exhibits at least 60% mRNA inhibition at a 20 nM oligonucleotide concentration when determined using a cell assay when compared with a control cell. In some aspects, the oligonucleotide exhibits at least 70% mRNA inhibition at a 2 nM oligonucleotide concentration when determined using a cell assay when compared with a control cell. In some aspects, the oligonucleotide exhibits at least 85% mRNA inhibition at a 2 nM oligonucleotide concentration when determined using a cell assay when compared with a control cell.

The cell assay can comprise transfecting mammalian cells, such as HEK293, NIH3T3, or HeLa cells, with the desired concentration of oligonucleotide (e.g., 2 nM or 20 nM) using LIPOFECTAMINE™ 2000 (Invitrogen) and comparing MLH3 mRNA levels of transfected cells to MLH3 levels of control cells. Control cells can be transfected with oligonucleotides not specific to MLH3 or mock transfected mRNA levels can be determined using RT-qPCR and MLH3 mRNA levels can be normalized to GAPDH mRNA levels. The percent inhibition can be calculated as the percent of MLH3 mRNA concentration relative to the MLH3 concentration of the control cells.

In some aspects, the oligonucleotide or contiguous nucleotide region thereof, has a gapmer design or structure also referred herein merely as gapmer." In a gapmer structure the oligonucleotide comprises at least three distinct structural regions a 5'-flanking sequence (also known as a 5'-wing), a DNA core sequence (also known as a gap) and a 3'-flanking sequence (also known as a 3'-wing), in "5->3' orientation. In this design, the 5' and 3' flanking sequences comprise at least one alternative nucleoside which is adjacent to a DNA core sequence, and can in some aspects comprise a contiguous stretch of 2-7 alternative nucleosides, or a contiguous stretch of alternative and DNA nucleosides (mixed flanking sequences comprising both alternative and DNA nucleosides).

The length of the 5'-flanking sequence region can be at least two nucleosides in length (e.g., at least at least 2, at least 3, at least 4, at least 5, or more nucleosides in length). The length of the 3'-flanking sequence region can be at least two nucleosides in length (e.g., at least 2, at least 3, at least at least 4, at least 5, or more nucleosides in length) The 5' and 3' flanking sequences can be symmetrical or asymmetrical with respect to the number of nucleosides they comprise. In some aspects, the DNA core sequence comprises about 10 nucleosides flanked by a 5' and a 3' flanking sequence each comprising about 5 nucleosides, also referred to as a 5-10-5 gapmer.

Consequently, the nucleosides of the 5' flanking sequence and the 3' flanking sequence which are adjacent to the DNA core sequence are alternative nucleosides, such as 2' alternative nucleosides. The DNA core sequence comprises a contiguous stretch of nucleotides which are capable of recruiting RNase H, when the oligonucleotide is in duplex with the MLH3 target nucleic acid. In some aspects, the DNA core sequence comprises a contiguous stretch of 5-16 DNA nucleosides. In other aspects, the DNA core sequence comprises a region of at least 10 contiguous nucleobases having at least 80% (e.g., at least 85%, at least 90%, at least 95%, or at least 99%) complementarity to a MLH3 gene. In some aspects, the gapmer comprises a region complementary to at least 17 contiguous nucleotides, 19-23 contiguous nucleotides, or 19 contiguous nucleotides of a MLH3 gene.

The gapmer is complementary to the MLH3 target nucleic acid, and can therefore be the contiguous nucleoside region of the oligonucleotide.

The 5' and 3' flanking sequences, flanking the 5' and 3' ends of the DNA core sequence, can comprise one or more affinity enhancing alternative nucleosides. In some aspects, the 5' and/or 3' flanking sequence comprises at least one 2'-O-methoxyethyl (MOE) nucleoside. In some aspects, the 5' and/or 3' flanking sequences, contain at least tv MOE nucleosides. In some aspects, the 5' flanking sequence comprises at least one MOE nucleoside. In some aspects, both the 5' and 3' flanking sequence comprise a MOE nucleoside. In some aspects, all the nucleosides in the flanking sequences are MOE nucleosides. In other aspects, the flanking sequence can comprise both MOE nucleosides and other nucleosides (mixed flanking sequence), such as DNA nucleosides and/or non-MOE alternative nucleosides, such as bicyclic nucleosides (BNAs) (e.g., LNA nucleosides or cET nucleosides), or other 2' substituted nucleosides. In this case the DNA core sequence is defined as a contiguous sequence of at least 5 RNase H recruiting nucleosides (such as 5-16 DNA nucleosides) flanked at the 5' and 3' end by an affinity enhancing alternative nucleoside, such as an MOE nucleoside.

In other aspects, the 5' and/or 3' flanking sequence comprises at least one BNA (e.g., at least one LNA nucleoside or cET nucleoside). In some aspects, 5' and/or 3' flanking sequence comprises at least 2 bicyclic nucleosides. In some aspects, the 5' flanking sequence comprises at least one BNA. In some aspects, both the 5' and 3' flanking sequence comprise a BNA. In some aspects, all the nucleosides in the flanking sequences are BNAs. In other aspects, the flanking sequence can comprise both BNAs and other nucleosides (mixed flanking sequences), such as DNA nucleosides and/or non-BNA alternative nucleosides, such as 2' substituted nucleosides. In this case the DNA core sequence is defined as a contiguous sequence of at least five RNase H recruiting nucleosides (such as 5-16 DNA nucleosides) flanked at the 5' and 3' end by an affinity enhancing alternative nucleoside, such as a BNA, such as an LNA, such as beta-D-oxy-LNA.

The 5' flank attached to the 5' end of the DNA core sequence comprises, contains, or consists of at least one alternative sugar moiety (e.g., at least three, at least four, at least five, at least six, at least seven, or more alternative sugar moieties). In some aspects, the flanking sequence comprises or consists of from 1 to 7 alternative nucleobases, such as from 2 to 6 alternative nucleobases, such as from 2 to 5 alternative nucleobases, such as from 2 to 4 alternative nucleobases, such as from 1 to 3 alternative nucleobases, such as one, two, three or four alternative nucleobases. In some aspects, the flanking sequence comprises or consists of at least one alternative internucleoside linkage (e.g., at least three, at least four, at least five, at least six, at least seven, or more alternative internucleoside linkages).

The 3' flank attached to the 3' end of the DNA core sequence comprises, contains, or consists of at least one alternative sugar moiety (e.g., at least three, at least four, at least five, at least six, at least seven, or more alternative sugar moieties). In some aspects, the flanking sequence comprises or consists of from 1 to 7 alternative nucleobases, such as from 2 to 6 alternative nucleobases, such as from 2 to 5 alternative nucleobases, such as from 2 to 4 alternative nucleobases, such as from 1 to 3 alternative nucleobases, such as one, two, three, or four alternative nucleobases. In some aspects, the flanking sequence comprises or consists of at least one alternative internucleoside linkage (e.g., at least three, at least four, at least five, at least six, at least seven, or more alternative internucleoside linkages).

In an aspect, one or more or all of the alternative sugar moieties in the flanking sequence are 2' alternative sugar moieties.

In a further aspect, one or more of the 2' alternative sugar moieties in the wing regions are selected from 2'-O-alkyl-sugar moieties, 7-O-methyl-sugar moieties, 2'-amino-sugar moieties, 7-fluoro-sugar moieties, 2'-alkoxy-sugar moieties, MOE sugar moieties, LNA sugar moieties, arabino nucleic acid (ANA) sugar moieties, and 2'-fluoro-ANA sugar moieties.

In one aspect, all the alternative nucleosides in the flanking sequences are bicyclic nucleosides. In a further aspect, the bicyclic nucleosides in the flanking sequences are independently selected from the group consisting of oxy-LNA, thio-LNA, amino-LNA, cET, and/or ENA, in either the beta-D or alpha-L configurations or combinations thereof.

In some aspects, the one or more alternative internucleoside linkages in the flanking sequences are phosphorothioate internucleoside linkages. In some aspects, the phosphorothioate linkages are stereochemically pure phosphorothioate linkages. In some aspects, the phosphorothioate linkages are Sp phosphorothioate linkages. In other aspects, the phosphorothioate linkages are Rp phosphorothioate linkages. In some aspects, the alternative internucleoside linkages are 2'-alkoxy internucleoside linkages. In other aspects, the alternative internucleoside linkages are alkyl phosphate internucleoside linkages.

The DNA core sequence can comprise, contain, or consist of at least 5-16 consecutive DNA nucleosides capable of recruiting RNase H. In some aspects, all of the nucleosides of the DNA core sequence are DNA units. In further aspects, the DNA core region can consist of a mixture of DNA and other nucleosides capable of mediating RNase H cleavage. In some aspects, at least 50% of the nucleosides of the DNA core sequence are DNA, such as at least 60%, at least 70% or at least 80%, or at least 90% DNA. In some aspects, all of the nucelosides of the DNA core sequence are RNA units.

The oligonucleotide comprises a contiguous region which is complementary to the target nucleic acid. In some aspects, the oligonucleotide can further comprise additional linked nucleosides positioned 5' and/or 3' to either the 5' and 3' flanking sequences. These additional linked nucleosides can be attached to the 5' end of the 5' flanking sequence or the 3' end of the 3' flanking sequence, respectively. The additional nucleosides can, in some aspects, form part of the contiguous sequence which is complementary to the target nucleic acid, or in other aspects, can be non-complementary to the target nucleic acid.

The inclusion of the additional nucleosides at either, or both of the 5' and 3' flanking sequences can independently comprise one, two, three, four, or five additional nucleotides, which can be complementary or non-complementary to the target nucleic acid. In this respect, the oligonucleotide can, in some aspects, comprise a contiguous sequence capable of modulating the target which is flanked at the 5' and/or 3' end by additional nucleotides. Such additional nucleosides can serve as a nuclease susceptible biocleavable linker, and can therefore be used to attach a functional group such as a conjugate moiety to the oligonucleotide. In some aspects, the additional 5' and/or 3' end nucleosides are linked with phosphodiester linkages, and can be DNA or RNA. In another aspect, the additional 5' and/or 3' end nucleosides are alternative nucleosides which can for example be included to enhance nuclease stability or for ease of synthesis.

In other aspects, the oligonucleotides utilize "altimer" design and comprise alternating 2'-fluoro-ANA and DNA regions that are alternated every three nucleosides. Altimer oligonucleotides are discussed in more detail in Min, et al, Bioorganic & Medicinal Chemistry Letters, 2002, 12(18): 2651-2654 and Kalota, et al., Nuc Acid Res. 2006, 34(2): 451-61 (herein incorporated by reference).

In other aspects, the oligonucleotides utilize "hemimer" design and comprise a single 2'-modified flanking sequence adjacent to (on either side of the 5' or the 3' side of) a DNA core sequence. Hemimer oligonucleotides are discussed in more detail in Geary et al., 2001, J. Pharm. Exp. Therap., 296: 898-904 (herein incorporated by reference).

In some aspects, an oligonucleotide has a nucleic acid sequence with at least 50% (e.g., at least 50%, at least 60%, at least 70%, at least 80%, at least 85%, at least 90%, at least 95%, at least 96%, at least 97%, at least 98%, at least 99%, or 100%) sequence identity to the nucleic acid sequence of any one of SEQ ID NOs: 6-4710. In some aspects, an oligonucleotide has a nucleic acid sequence with at least 85% sequence identity to the nucleic acid sequence of any one of SEQ ID NOs: 6-4710.

It will be understood that, although the sequences in SEQ ID NOs: 6-4710 are described as unmodified and/or unconjugated sequences, the nucleosides of the oligonucleotide can comprise any one of the sequences set forth in any one of SEQ ID NOs. 6-4710 that is an alternative nucleoside and/or conjugated as described in detail below.

The skilled person is well aware that oligonucleotides having a structure of between about 18-base pairs can be particularly effective in inducing RNase H-mediated degradation. However, one can appreciate that shorter or longer oligonucleotides can be effective. In the aspects described above, by virtue of the nature of the oligonucleotide sequences provided herein, oligonucleotides described herein can include shorter or longer oligonucleotide sequences. It can be reasonably expected that shorter oligonucleotides minus only a few linked nucleosides on one or both ends can be similarly effective as compared to the oligonucleotides described above. Hence, oligonucleotides having a sequence of at least 8, 9, 10, 11, 12, 13, 14, 15, 16, 17, 18, 19, 20, or more contiguous linked nucleosides derived from one of the sequences provided herein, and differing in their ability to inhibit the expression of a MLH3 gene by not more than about 5, 10, 15, 20, 25, or 30% inhibition from an oligonucleotide comprising the full sequence, are contemplated to be within the scope.

The oligonucleotides described herein can function via nuclease mediated degradation of the target nucleic acid, where the oligonucleotides are capable of recruiting a nuclease, such as an endonuclease like endoribonuclease (RNase) (e.g., RNase H). Examples of oligonucleotide designs which operate via nuclease mediated mechanisms are oligonucleotides which typically comprise a region of at least 5 or 6 DNA nucleosides and are flanked on one side or both sides by affinity enhancing alternative nucleosides, for example gapmers, headmers, and tailmers.

The RNase H activity of an oligonucleotide refers to its ability to recruit RNase H when in a duplex with a complementary RNA molecule. WO01/23613 provides in vitro methods for determining RNase H activity, which can be used to determine the ability to recruit RNase H. Typically an oligonucleotide is deemed capable of recruiting RNase H if it, when provided with a complementary target nucleic acid sequence, has an initial rate, as measured in pmol/N/min, of at least 5%, such as at least 10% or more than 20% of the of the initial rate determined when using an oligonucleotide having the same base sequence as the modified oligonucleotide being tested, but containing only DNA monomers, with phosphorothioate linkages between all monomers in the oligonucleotide, and using the methodology provided by Example 91-95 of WO01/23613 (hereby incorporated by reference).

Furthermore, the oligonucleotides described herein identify a site(s) in a MLH3 transcript that is susceptible to RNase H-mediated cleavage. As used herein, an oligonucleotide is said to target within a particular site of an RNA transcript if the oligonucleotide promotes cleavage of the transcript anywhere within that particular site. Such an oligonucleotide will generally include at least about 5-10 contiguous linked nucleosides from one of the sequences provided herein coupled to additional linked nucleoside sequences taken from the region contiguous to the selected sequence in a MLH3 gene.

Inhibitory oligonucleotides can be designed by methods well known in the art. While a target sequence is generally about 10-30 linked nucleosides in length, there is wide variation in the suitability of particular sequences in this range for directing cleavage of any given target RNA.

Oligonucleotides with homology sufficient to provide sequence specificity required to uniquely degrade any RNA can be designed using programs known in the art.

Systematic testing of several designed species for optimization of the inhibitory oligonucleotide sequence can be undertaken in accordance with the teachings provided herein. Considerations when designing interfering oligonucleotides include, but are not limited to, biophysical, thermodynamic, and structural considerations, base preferences at specific positions, and homology. The making and use of inhibitory therapeutic agents based on non-coding oligonucleotides are also known in the art.

Various software packages and the guidelines set out herein provide guidance for the identification of optimal target sequences for any given gene target, but an empirical approach can be taken in which a "window" or "mask" of a given size (as a non-limiting example, 21 nucleotides) is literally or figuratively (including, e.g., in silico) placed on the target RNA sequence to identify sequences in the size range that can serve as target sequences. By moving the sequence "window" progressively one nucleotide upstream or downstream of an initial target sequence location, the next potential target sequence can be identified, until the complete set of possible sequences is identified for any given target size selected. This process, coupled with systematic synthesis and testing of the identified sequences (using assays as described herein or as known in the art) to identify those sequences that perform optimally can identify those RNA sequences that, when targeted with an oligonucleotide agent, mediate the best inhibition of target gene expression Thus, while the sequences identified herein represent effective target sequences, it is contemplated that further optimization of inhibition efficiency can be achieved by progressively "walking the window" one nucleotide upstream or downstream of the given sequences to identify sequences with equal or better inhibition characteristics.

Further, it is contemplated that for any sequence identified herein, further optimization could be achieved by systematically either adding or removing linked nucleosides to generate longer or shorter sequences and testing those sequences generated by walking a window of the longer or shorter size up or down the target RNA from that point. Again, coupling this approach to generating new candidate targets with testing for effectiveness of oligonucleotides based on those target sequences in an inhibition assay as known in the art and/or as described herein can lead to further improvements in the efficiency of inhibition.

Further still, such optimized sequences can be adjusted by, e.g., the introduction of alternative nucleosides, alternative sugar moieties, and/or alternative internudeosidic linkages as described herein or as known in the art, including alternative nucleosides, alternative sugar moieties, and/or alternative internucleosidic linkages as known in the art and/or discussed herein to further optimize the molecule (e.g., increasing serum stability or circulating half-life, increasing thermal stability, enhancing transmembrane delivery, targeting to a particular location or cell type, increasing interaction with silencing pathway enzymes, increasing release from endosomes) as an expression inhibitor. An oligonucleotide agent as described herein can contain one or more mismatches to the target sequence. In one aspect, an oligonucleotide as described herein contains no more than 3 mismatches. If the oligonucleotide contains mismatches to a target sequence, in some aspects, the area of mismatch is not located in the center of the region of complementarity. If the oligonucleotide contains mismatches to the target sequence, in some aspects, the mismatch should be restricted to be within the last 5 nucleotides from either the 5'- or 3-end of the region of complementarity. For example, for a 30-linked nucleoside oligonucleotide agent, the contiguous nucleobase region which is complementary to a region of a MLH3 gene, generally does not contain any mismatch within the central 5-10 linked nucleosides. The methods described herein or methods known in the art can be used to determine whether an oligonucleotide containing a mismatch to a target sequence is effective in inhibiting the expression of a MLH3 gene. Consideration of the efficacy of oligonucleotides with mismatches in inhibiting expression of a MLH3 gene is important, especially if the particular region of complementarity in a MLH3 gene is known to have polymorphic sequence variation within the population.

Construction of vectors for expression of polynucleotides for use can be accomplished using conventional techniques which do not require detailed explanation to one of ordinary skill in the art. For generation of efficient expression vectors, it is necessary to have regulatory sequences that control the expression of the polynucleotide. These regulatory sequences include promoter and enhancer sequences and are influenced by specific cellular factors that interact with these sequences, and are well known in the art.

A. Alternative Oligonucleosides.

In one aspect, one or more of the linked nucleosides or intemucleosidic linkages of the oligonucleotide, is naturally occurring, and does not comprise, e.g., chemical modifications and/or conjugations known in the art and described herein. In another aspect, one or more of the linked nucleosides or internucleosidic linkages of an oligonucleotide described herein, is chemically modified to enhance stability or other beneficial characteristics. Without being bound by theory, it is believed that certain modifications can increase nuclease resistance and/or serum stability, or decrease immunogenicity. For example, oligonucleotides can contain nucleotides found to occur naturally in DNA or RNA (e.g., adenine, thymidine, guanosine, cytidine, undine, or inosine) or can contain alternative nucleosides or internudeosidic linkages which have one or more chemical modifications to one or more components of the nucleotide (e.g., the nucleobase, sugar, or phospho-linker moiety). Oligonucleotides can be linked to one another through naturally occurring phosphodiester bonds, or can contain alternative linkages (e.g., covalently linked through phosphorothioate (e.g., Sp phosphorothioate or Rp phosphorothioate), 3'-methylenephosphonate, 5'-methylenephosphonate, 3'-phosphoamidate, 2'-5' phosphodiester, guanidinium, S-methylthiourea, 2'-alkoxy, alkyl phosphate, or peptide bonds).

In some aspects, substantially all of the nucleosides or internucleosidic linkages of an oligonucleotide are alternative nucleosides. In other aspects, all of the nudeosides or internucleosidic linkages of an oligonucleotide described herein are alternative nucleosides. Oligonucleotides in which "substantially all of the nucleosides are alternative nucleosides" are largely but not wholly modified and can include not more than five, four, three, two, or one naturally-occurring nucleosides. In still other aspects, oligonucleotides can include not more than five, four, three, two, or one alternative nucleosides.

The nucleic acids can be synthesized and/or modified by methods well established in the art, such as those described in "Current protocols in nucleic acid chemistry," Beaucage, S. L. et al. (Edrs.), John Wiley & Sons, Inc., New York, N.Y., USA, which is hereby incorporated herein by reference. Alternative nucleotides and nucleosides include those with modifications including, for example, end modifications, e.g., 5'-end modifications (phosphorylation, conjugation, inverted linkages) or 3'-end modifications (conjugation, DNA nucleotides, inverted linkages, etc.); base modifications, e.g., replacement with stabilizing bases, destabilizing bases, or bases that base pair with an expanded repertoire of partners, removal of bases (abasic nucleotides), or conjugated bases; sugar modifications (e.g., at the 2'-position or 4'-position) or replacement of the sugar; and/or backbone modifications, including modification or replacement of the phosphodiester linkages. The nucleobase can be an isonucleoside in which the nucleobase is moved from the C1 position of the sugar moiety to a different position (e.g. C2, C3, C4, or C5). Specific examples of oligonucleotide compounds useful in the aspects described herein include, but are not limited to alternative nucleosides containing modified backbones or no natural internucleoside linkages. Nucleotides and nucleosides having modified backbones include, among others, those that do not have a phosphorus atom in the backbone. For the purposes of this specification, and as sometimes referenced in the art, alternative RNAs that do not have a phosphorus atom in their internucleoside backbone can be considered to be oligonucleosides. In some aspects, an oligonucleotide will have a phosphorus atom in its internucleoside backbone.

Alternative internucleoside linkages include, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boronophosphates having normal 3'-5' linkages, 2'-5'-linked analogs of these, and those having inverted polarity wherein the adjacent pairs of nucleoside units are linked 3'-5' to 5'-3' or 7-5' to 5'-2'. Various salts, mixed salts, and free acid forms are also included.

Representative U.S. patents that teach the preparation of the above phosphorus-containing linkages include, but are not limited to, U.S. Pat. Nos. 3,687,808; 4,469,863; 4,476,301; 5,023,243; 5,177,195; 5,188,897; 5,264,423; 5,276,019; 5,278,302; 5,286,717; 5,321,131; 5,399,676; 5,405,939; 5,453,496; 5,455,233; 5,466,677, 5,476,925; 5,519,126; 5,536,821; 5,541,316; 5,550,111; 5,563,253; 5,571,799; 5,587,361, 5,625,050; 6,028,188, 6,124,445; 6,160, 109, 6,169,170; 6,172,209, 6,239,265; 6,277,603, 6,326, 199; 6.346,614, 6,444,423; 6,531,590; 6,534,639; 6,608, 035, 6,683,167; 6,858,715, 6,867,294; 6,878,805; 7,015, 315; 7,041,816, 7,273,933; 7,321,029, and U.S. Pat. RE39464, the entire contents of each of which are hereby incorporated herein by reference.

Alternative internucleoside linkages that do not include a phosphorus atom therein have backbones that are formed by short chain alkyl or cycloalkyl intemudeoside linkages, mixed heteroatoms and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones, methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S, and $CH_2$ component parts.

Representative U.S. patents that teach the preparation of the above oligonudeosides include, but are not limited to, U.S. Pat. Nos. 5,034,506; 5,166,315; 5,185,444; 5,214,134; 5,216,141; 5,235,033; 5,64,562; 5,264,564; 5,405,938; 5,434,257; 5,466,677; 5,470,967; 5,489,677; 5,541,307; 5,561,225; 5,596,086; 5,602,240; 5,608,046; 5,610,289; 5,618,704; 5,623,070; 5,663,312; 5,633,360; 5,677,437; and, 5,677,439, the entire contents of each of which are hereby incorporated herein by reference.

In other aspects, suitable oligonucleotides include those in which both the sugar and the internucleoside linkage, i.e., the backbone, of the nucleotide units are replaced. The base units are maintained for hybridization with an appropriate nucleic acid target compound. One such oligomeric compound, a mimetic that has been shown to have excellent hybridization properties, is referred to as a peptide nucleic acid (PNA). In PNA compounds, the sugar of a nucleoside is replaced with an amide containing backbone, in particular an aminoethylglycine backbone. The nucleobases are retained and are bound directly or indirectly to aza nitrogen atoms of the amide portion of the backbone. Representative U.S. patents that teach the preparation of PNA compounds include, but are not limited to, U.S. Pat. Nos. 5,539,082; 5,714,331; and 5,719,262, the entire contents of each of which are hereby incorporated herein by reference. Additional PNA compounds suitable for use in the oligonucleotides are described in, for example, in Nielsen et al., Science, 1991, 254, 1497-1500.

Some aspects include oligonucleotides with phosphorothioate backbones and oligonucleotides with heteroatom backbones, and in particular —CH—NH—$CH_2$—, —$CH_2$—N($CH_3$)—O—$CH_2$-[known as a methylene (methylimino) or MMI backbone], —$CH_2$—O—N($CH_3$)—$CH_2$—, —$CH_2$—N($CH_3$)—N($CH_3$)—$CH_2$— and —N($CH_3$)—$CH_2$—$CH_2$—[wherein the native phosphodiester backbone is represented as —O—P—O—$CH_2$—] of the above-referenced U.S. Pat. No. 5,489,677, and the amide backbones of the above-referenced U.S. Pat. No. 5,602,240 In some aspects, the oligonucleotides featured herein have morpholino backbone structures of the above-referenced U.S. Pat. No. 5,034,506. In other aspects, the oligonucleotides described herein include phosphorodiamidate morpholino oligomers (PMO), in which the deoxyribose moiety is replaced by a morpholine ring, and the charged phosphodiester inter-subunit linkage is replaced by an uncharged phophorodiamidate linkage, as described in Summerton, et al., Antisense Nucleic Acid Drug Dev. 1997, 7.63-70.

Alternative nucleosides and nucleotides can contain one or more substituted sugar moieties. The oligonucleotides, e.g., oligonucleotides, featured herein can include one of the following at the 2'-position: OH; F; O-, S-, or N-alkyl; O-, S-, or N-alkenyl; O-, S- or N-alkynyl; or O-alkyl-O-alkyl, wherein the alkyl, alkenyl and alkynyl can be substituted or unsubstituted $C_1$ to $C_{10}$ alkyl or $C_2$ to $C_{10}$ alkenyl and alkynyl. Exemplary suitable modifications include —O[$(CH_2)_n$O]$_m$$CH_3$, —O$(CH_2)_n$O$CH_3$, —O$(CH_2)_n$—$NH_2$, —O$(CH_2)_n$$CH_3$, —O$(CH_2)_n$—ONH2, and —O$(CH_2)_n$—ON[$(CH_2)_n$$CH_3$]2, where n and m are from 1 to about 10. In other aspects, oligonucleotides include one of the following at the 2' position: $C_1$ to $C_{10}$ lower alkyl, substituted lower alkyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $NO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties of an oligonucleotide, or a group for improving the pharmacodynamic properties of an oligonucleotide, and other substituents having similar properties. In some aspects, the modification includes a 2'-methoxyethoxy (2'-O—$CH_2CH_2OCH_3$, also known as 2-O-(2-methoxyethyl) or 2'-MOE) (Martin et al., Helv. Chin. Acta, 1995, 78-486-504) i.e., an alkoxy-alkoxy group. MOE nucleosides confer several beneficial properties to oligonucleotides including, but not limited to, increased nuclease resistance, improved pharmacokinetics properties, reduced non-specific protein binding, reduced toxicity, reduced immunostimulatory properties, and enhanced target affinity as compared to unmodified oligonucleotides.

Another exemplary alternative contains 2'-dimethylaminooxyethoxy, i.e., a —O($CH_2$)2ON($CH_3$)2 group, also known as 2'-DMAOE, as described in examples herein below, and 2'-dimethylaminoethoxyethoxy (also known in the art as 2'-O-dimethylaminoethoxyethyl or 2'-DMAEOE), i.e., 2'-O—$(CH_2)_2$—O—$(CH_2)_2$—N$(CH_3)_2$. Further exemplary alternatives include: 5-Me-2'-F nucleotides, 5-Me-2'-OMe nucleotides, 5-Me-2'-deoxynucleotides, (both R and S isomers in these three families); 2'-alkoxyalkyl; and 2'-NMA (N-methylacetamide).

Other alternatives include 2'-methoxy (2-$OCH_3$), 2'-aminopropoxy (2'-$OCH_2CH_2CH_2NH_2$) and 2'-fluoro (2'-F). Similar modifications can also be made at other positions on the nucleosides and nucleotides of an oligonucleotide, particularly the 3' position of the sugar on the 3' terminal nucleotide or in 2'-5' linked oligonucleotides and the 5' position of 5' terminal nucleotide. Oligonucleotides can have sugar mimetics such as cyclobutyl moieties in place of the pentofuranosyl sugar. Representative U.S. patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920, certain of which are commonly owned with the instant application. The entire contents of each of the foregoing are hereby incorporated herein by reference.

An oligonucleotide can include nucleobase (often referred to in the art simply as "base") alternatives (e.g., modifications or substitutions). Unmodified or natural nucleobases include the purine bases adenine (A) and guanine (G), and the pyrimidine bases thymine (T), cytosine (C) and uracil (U). Alternative nucleobases include other synthetic and natural nucleobases such as 5-methylcytidine, 5-hydroxymethylcytidine, 5-formylcytidine, 5-carboxycytidine, pyrrolocytidine, dideoxycytidine, undine, 5-methoxyuridine, 5-hydroxydeoxyuridine, dihydroundine, 4-thiourdine, pseudouridine, 1-methyl-pseudouridine, deoxyundine, 5-hydroxybutynl-2'-deoxyuridine, xanthine, hypoxanthine, 7-deaza-xanthine, thienoguanine, 8-aza-7-deazaguanosine, 7-methylguanosine, 7-deazaguanosine, 6-aminomethyl-7-deazaguanosine, 8-aminoguanine, 2,2,7-tnmethylguanosine, 8-methyladenine, 8-azidoadenine, 7-methyladenine, 7-deazaadenine, 3-deazaadenine, 2,6-diaminopurine, 2-aminopurine, 7-deaza-8-aza-adenine, 8-amino-adenine, thymine, dideoxythymine, 5-nitroindole, 2-aminoadenine, 6-methyl and other alkyl derivatives of adenine and guanine, 2-propyl and other alkyl derivatives of adenine and guanine, 2-thiouridine, 2thiothymine and 2-thiocytosine, 5-halouracil and cytosine, 5-propynyl uridine and cytidine, 6-azo uridine, cytidine and thymine, 4-thiouridine, 8-halo, 8-amino, 8-thiol, 8-thioalkyl, 8-hydroxyl anal other 8-substituted adenines and guanines, 5-halo, particularly 5-bromo, 5-trifluoromethyl and other 5-substituted uridines and cytidines, 8-azaguanine and 8-azaadenine, and 3-deazaguanine. Further nucleobases include those disclosed in U.S. Pat. No. 3,687,808, those disclosed in Modified Nucleosides in Biochemistry, Biotechnology and Medicine, Herdewijn, P. ed. Wiley-VCH, 2008; those disclosed in. The Concise Encyclopedia Of Polymer Science And Engineering, pages 858-859, Kroschwitz, J. L, ed. John Wiley & Sons, 1990, these disclosed by Englisch et al., (1991) Angewandte Chemie, International Edition, 30:613, and those disclosed by Sanghvi, Y S., Chapter 15, Antisense Research and Applications, pages 289-302, Crooke, S. T. and Lebleu, B., Ed., CRC Press, 1993. Certain of these nucleobases are particularly useful for increasing the binding affinity of the oligonucleotides. These include 5-substituted pyrimidines, 6-azapyrimidines, and N-2, N-6 and 0-6 substituted purines, including 2-aminopropyladenine, 5-propynyluracil, and 5-propynylcytosine. 5-methylcytosine substitutions have been shown to increase nucleic acid duplex stability by 0.6-1.2° C. (Sanghvi, Y. S., Crooke, S. T. and Lebleu, B., Eds., Antisense Research and Applications, CRC Press, Boca Raton, 1993, pp. 276-278) and are exemplary base substitutions, even more particularly when combined with 2'-O-methoxyethyl sugar modifications.

Representative U.S. patents that teach the preparation of certain of the above noted alternative nucleobases as well as other alternative nucleobases include, but are not limited to, the above noted U.S. Pat. Nos. 3,687,808, 4,845,205; 5,130, 30; 5,134,066; 5,175,273; 5,367,066; 5,432,272; 5,457,187, 5,459,255; 5,484,908, 5,502,177; 5,525,711, 5,552,540; 5,587,469, 5,594,121, 5,596,091; 5,614,617; 5,681,941; 5,750,692; 6,015,886; 6,147,200; 6,166,197; 6,222,025; 6,235,887; 6,380,368; 6,528,640; 6,639,062; 6,617,438; 7,045,610; 7,427,672; and 7,495,088, the entire contents of each of which are hereby incorporated herein by reference.

In other aspects, the sugar moiety in the nucleotide can be a ribose molecule, optionally having a 2'-O-methyl, 2'-O-MOE, 2'-F, 2'-amino, 2'-O-propyl, 2'-aminopropyl, or 2'-OH modification.

An oligonucleotide can include one or more bicyclic sugar moieties. A "bicyclic sugar" is a furanosyl ring modified by the bridging of two atoms A "bicyclic nucleoside" ("BNA") is a nudeoside having a sugar moiety comprising a bridge connecting two carbon atoms of the sugar ring, thereby forming a bicyclic ring system. In some aspects, the bridge connects the 4'-carbon and the 2'-carbon of the sugar ring. Thus, in some aspects, an oligonucleotide can include one or more locked nucleosides. A locked nucleoside is a nucleoside having a modified ribose moiety in which the ribose moiety comprises an extra bridge connecting the 2' and 4' carbons. In other words, a locked nucleoside is a nucleoside comprising a bicyclic sugar moiety comprising a 4'—$CH_2$—O-2' bridge. This structure effectively "locks" the ribose in the 3'-endo structural conformation. The addition of locked nucleosides to oligonucleotides has been shown to increase oligonucleotide stability in serum, and to reduce off-target effects (Grunweller, A. et al., (2003) Nucleic Acids Research 31(12):3185-3193). Examples of bicyclic nucleosides for use in the polynucleotides include without limitation nucleosides comprising a bridge between the 4' and the 2' ribosyl ring atoms. In some aspects, the polynucleotide agents include one or more bicyclic nucleosides comprising a 4' to 2' bridge. Examples of such 4' to 2' bridged bicyclic nucleosides, include but are not limited to 4'-($CH_2$)—O-2 (LNA); 4'-($CH_2$)—S-2'; 4'—(CH:)2-O-2' (ENA); 4'—CH($CH_3$)—O-2' (also referred to as "constrained ethyl" or "cEt") and 4'-CH($CH_2OCH_3$)—O-2' (and analogs thereof; see, e.g., U.S. Pat. No. 7,399,845). 4'-C($CH_3$)(CHs)—O-2' (and analogs thereof, see e.g., U.S. Pat. No. 8,278,283); 4'—$CH_2$—N($OCH_3$)-2' (and analogs thereof, see e.g., U.S. Pat. No. 8,278,425); 4'—$CH_2$—O—N($CH_3$)2-2' (see, e.g., U.S. Patent Publication No. 2004/0171570); 4'—$CH_2$—N(R)—O-2', wherein R is H, C1-C12 alkyl, or a protecting group (see, e.g., U.S. Pat. No. 7,427,672); 4'—$CH_2$—C(H)($CH_3$)-2' (see, e.g., Chattopadhyaya et al., J. Org. Chem., 2009, 74, 118-134); and 4'—$CH_2$—C(=$CH_2$)-2' (and analogs thereof; see, e.g., U.S. Pat. No. 8,278,426). The entire contents of each of the foregoing are hereby incorporated herein by reference.

Additional representative U.S. Patents and US Patent Publications that teach the preparation of locked nucleic acid nucleotides include, but are not limited to, the following: U.S. Pat. Nos. 6,268,490; 6,525,191; 6,670,461; 6,770,748, 6,794,499; 6,998,484, 7,053,207; 7,034,133, 7,084,125; 7,399,845; 7,427,672; 7,569,686, 7,741,457; 8,022,193, 8,030,467; 8,278,425, 8,278,426; 8,278,283. US 2008/0039618; and US 2009/0012281, the entire contents of each of which are hereby incorporated herein by reference Any of the foregoing bicyclic nucleosides can be prepared having one or more stereochemical sugar configurations including for example α-L-ribofuranose and β-D-ribofuranose (see WO 99/14226).

An oligonucleotide can be modified to include one or more constrained ethyl nucleosides. As used herein, a "constrained ethyl nucleoside" or "cEt" is a locked nucleoside comprising a bicyclic sugar moiety comprising a 4'—CH($CH_3$)—O-2' bridge. In one aspect, a constrained ethyl nucleoside is in the S conformation referred to herein as "S-cEt."

An oligonucleotide can include one or more "conformationally restricted nucleosides" ("CRN") CRN are nucleoside analogs with a linker connecting the C2' and C4' carbons of ribose or the C3 and —C5' carbons of ribose CRN lock the ribose ring into a stable conformation and increase the hybridization affinity to mRNA. The linker is of sufficient length to place the oxygen in an optimal position for stability and affinity resulting in less ribose ring puckering.

Representative publications that teach the preparation of certain of the above noted CRN include, but are not limited to, US Patent Publication No. 2013/0190383; and PCT publication WO 2013/036868, the entire contents of each of which are hereby incorporated herein by reference.

In some aspects, an oligonucleotide comprises one or more monomers that are UNA (unlocked nucleoside) nucleosides. UNA is unlocked acyclic nucleoside, wherein any of the bonds of the sugar has been removed, forming an unlocked "sugar" residue. In one example, UNA also encompasses monomer with bonds between C1'—C4' have been removed (i.e. the covalent carbon-oxygen-carbon bond between the C1' and C4' carbons). In another example, the C2'—C3' bond (i.e. the covalent carbon-carbon bond between the C2' and C3' carbons) of the sugar has been removed (see Nuc. Acids Symp. Series, 52, 133-134 (2008) and Fluiter et al., Mol. Biosyst., 2009, 10, 1039 hereby incorporated by reference).

Representative U.S. publications that teach the preparation of UNA include, but are not limited to, U.S. Pat. No. 8,314,227; and US Patent Publication Nos. 2013/0096289; 2013/0011922. and 2011/0313020, the entire contents of each of which are hereby incorporated herein by reference.

The ribose molecule can be modified with a cyclopropane ring to produce a tricyclodeoxynucleic acid (tricyclo DNA) The ribose moiety can be substituted for another sugar such as 1,5,-anhydrohexitol, threose to produce a threose nucleoside (TNA), or arabinose to produce an arabino nucleoside. The ribose molecule can be replaced with non-sugars such as cyclohexene to produce cyclohexene nucleoside or glycol to produce glycol nucleosides.

Potentially stabilizing modifications to the ends of nucleoside molecules can include N-(acetylaminocaproyl)-4-hydroxyprolinol (Hyp-C6-NHAc), N-(caproyl-4-hydroxyprolinol (Hyp-C6), N-(acetyl-4-hydroxyprolinol (Hyp-NHAc), thymidine-2'-O-deoxythymidine (ether), N-(aminocaproyl)-4-hydroxyprolinol (Hyp-C6-amino), 2-docosanoyl-uridine-3"-phosphate, inverted base dT(idT) and others. Disclosure of this modification can be found in PCT Publication No. WO 2011/005861.

Other alternatives chemistries of an oligonucleotide include a 5' phosphate or 5' phosphate mimic, e.g., a 5'-terminal phosphate or phosphate mimic of an oligonucleotide. Suitable phosphate mimics are disclosed in, for example US Patent Publication No 2012/0157511, the entire contents of which are incorporated herein by reference.

Exemplary oligonucleotides comprise nucleosides with alternative sugar moieties and can comprise DNA or RNA nucleosides. In some aspects, the oligonucleotide comprises nucleosides comprising alternative sugar moieties and DNA nucleosides. Incorporation of alternative nucleosides into the oligonucleotide can enhance the affinity of the oligonucleotide for the target nucleic acid. In that case, the alternative nucleosides can be referred to as affinity enhancing alternative nucleotides.

In some aspects, the oligonucleotide comprises at least 1 alternative nucleoside, such as at least 2, at least 3, at least 4, at least 5, at least 6, at least 7, at least 8, at least 9, at least 10, at least 11, at least 12, at least 13, at least 14, at least 15 or at least 16 alternative nucleosides. In other aspects, the oligonucleotides comprise from 1 to 10 alternative nucleosides, such as from 2 to 9 alternative nucleosides, such as from 3 to 8 alternative nucleosides, such as from 4 to 7 alternative nucleosides, such as 6 or 7 alternative nucleosides. In an aspect, the oligonucleotide can comprise alternatives, which are independently selected from these three types of alternatives (alternative sugar moiety, alternative nucleobase, and alternative internucleoside linkage), or a combination thereof. In one aspect, the oligonucleotide comprises one or more nucleosides comprising alternative sugar moieties, e.g., 2' sugar alternative nucleosides. In some aspects, the oligonucleotide comprises the one or more 2 sugar alternative nucleoside independently selected from the group consisting of 2'-O-alkyl-RNA, 2'-O-methyl-RNA, 2'-alkoxy-RNA, 2'-O-methoxyethyl-RNA, 2'-amino-DNA, 2'-fluoro-DNA, arabino nucleic acid (ANA), 2'-fluoro-ANA, and BNA (e.g., LNA) nucleosides. In some aspects, the one or more alternative nucleoside is a BNA.

In some aspects, at least 1 of the alternative nucleosides is a BNA (e.g., an LNA), such as at least 2, such as at least 3, at least 4, at least 5, at least 6, at least 7, or at least 8 of the alternative nucleosides are BNAs. In a still further aspect, all the alternative nucleosides are BNAs.

In a further aspect the oligonucleotide comprises at least one alternative internucleoside linkage. In some aspects, the internucleoside linkages within the contiguous nucleotide sequence are phosphorothioate or boronophosphate internucleoside linkages. In some aspects, all the internucleotide linkages in the contiguous sequence of the oligonucleotide are phosphorothioate linkages. In some aspects, the phosphorothioate linkages are stereochemically pure phosphorothioate linkages. In some aspects, the phosphorothioate linkages are Sp phosphorothioate linkages. In other aspects, the phosphorothioate linkages are Rp phosphorothioate linkages.

In some aspects, the oligonucleotide comprises at least one alternative nucleoside which is a 2'-MOE-RNA, such as 2, 3, 4, 5, 6, 7, 8, 9, or 10.2'-MOE-RNA nucleoside units. In some aspects, the 2'-MOE-RNA nucleoside units are connected by phosphorothioate linkages. In some aspects, at least one of said alternative nucleoside is 2'-fluoro DNA, such as 2, 3, 4, 5, 6, 7, 8, 9, or 10.2'-fluoro-DNA nucleoside units. In some aspects, the oligonucleotide comprises at least one BNA unit and at least one 2' substituted modified nucleoside. In some aspects, the oligonucleotide comprises both 2' sugar modified nucleosides and DNA units. In some aspects, the oligonucleotide or contiguous nucleotide region thereof is a gapmer oligonucleotide.

B. Oligonucleotides Conjugated to Ligands

Oligonucleotides can be chemically linked to one or more ligands, moieties, or conjugates that enhance the activity, cellular distribution, or cellular uptake of the oligonucleotide. Such moieties include but are not limited to lipid moieties such as a cholesterol moiety (Letsinger et al., (1989) Proc. Natl. Acid. Sci. USA, 86: 6553-6556), cholic acid (Manoharan et al., (1994) Biorg. Med. Chem. Let., 4:1053-1060). a thioether, e.g., beryl-S-tritylthiol (Manoharan et al., (1992) Ann. N.Y. Acad. Sci., 660:306-309, Manoharan et al., (1993) Biorg. Med. Chem. Let., 3:2765-2770). a thiocholesterol (Oberhauser et al., (1992) Nucd. Acids Res., 20:533-538), an aliphatic chain, e.g., dodecandiol or undecyl residues (Saison-Behmoaras et al., (1991) EMBO J, 10:1111-1118; Kabanov et al, (1990) FEBS Lett, 259:327-330; Svinarchuk et al., (1993) Biochimie, 75:49-54), a phospholipid, e.g., di-hexadecyl-rac-glycerol or triethyl-ammonium 1,2-di-O-hexadecyl-rac-glycero-3-phosphonate (Manoharan et al., (1995) Tetrahedron Left, 36:3651-3654; Shea et al., (1990) Nucd. Acids Res., 18-3777-3783), a polyamine or a polyethylene glycol chain (Manoharan et al., (1995) Nucleosides & Nucleotides, 14-969-973), or adamantane acetic acid (Manoharan et al., (1995) Tetrahedron Lett., 36:3651-3654), a palmityl moiety (Mishra et al., (1995) Biochim. Biophys. Acta, 1264:229-237), or an octadecylamine or hexylamino-carbonyloxycholesterol moiety (Crooke et al., (1996) J. Pharmacol. Exp. Ther., 277:923-937).

In one aspect, a ligand alters the distribution, targeting, or lifetime of an oligonucleotide agent into which it is incorporated. In some aspects, a ligand provides an enhanced affinity for a selected target, e.g., molecule, cell or cell type, compartment, e.g., a cellular or organ compartment, tissue, organ, or region of the body, as, e.g., compared to a species absent such a ligand.

Ligands can include a naturally occurring substance, such as a protein (e.g., human serum albumin (HSA), low-density lipoprotein (LDL), or globulin); carbohydrate (e.g., a dextran, pullulan, chitin, chitosan, inulin, cyclodextrin, N-acetylglucosamine, N-acetylgalactosamine, or hyaluronic acid); or a lipid. The ligand can be a recombinant or synthetic molecule, such as a synthetic polymer, e.g., a synthetic polyamino acid. Examples of polyamino acids include polyamino acid is a polylysine (PLL), poly L-aspartic acid, poly L-glutamic acid, styrene-maleic acid anhydride copolymer, poly(L-lactide-co-glycolied) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly (2-ethylacryllic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an alpha helical peptide.

Ligands can include targeting groups, e.g., a cell or tissue targeting agent, e.g., a lectin, glycoprotein, lipid or protein, e.g., an antibody, that binds to a specified cell type such as a kidney cell. A targeting group can be a thyrotropin, melanotropin, lectin, glycoprotein, surfactant protein A, Mucin carbohydrate, multivalent lactose, multivalent galactose, N-acetyl-galactosamine, N-acetyl-gulucosamine multivalent mannose, multivalent fucose, glycosylated polyaminoacids, multivalent galactose, transferrin, bisphosphonate, polyglutamate, polyaspartate, a lipid, cholesterol, a steroid, bile acid, folate, vitamin B12, vitamin A, biotin, or an RGD peptide or RGD peptide mimetic.

Other examples of ligands include dyes, intercalating agents (e g acridines), cross-linkers (e g psoralen, mitomycin C), porphyrins (TPPC4, texaphyrin, Sapphyrin), polycyclic aromatic hydrocarbons (e.g., phenazine, dihydrophenazine), artificial endonucleases (e.g. EDTA), lipophilic molecules, e.g., cholesterol, cholic acid, adamantane acetic acid, 1-pyrene butyric acid, dihydrotestosterone, 1,3-Bis-O(hexadecyl)glycerol, geranyloxyhexyl group, hexadecylglycerol, borneol, menthol, 1,3-propanediol, heptadecyl group, palmitic acid, myristic acid, O3-(oleoyl)lithocholic acid, O3-(oleoyl)cholenic acid, dimethoxytrityl, or phenoxazine) and peptide conjugates (e.g., antennapedia peptide, Tat peptide), alkylating agents, phosphate, amino, mercapto, PEG (e.g., PEG-40K), MPEG, $[MPEG]_2$, polyamino, alkyl, substituted alkyl, radiolabeled markers, enzymes, haptens (e.g. biotin), transport/absorption facilitators (e.g., aspirin, vitamin E, folic acid), synthetic ribonucleases (e.g., imidazole, bisimidazole, histamine, imidazole clusters, acridine-imidazole conjugates, Eu3+ complexes of tetraazamacrocycles), dinitrophenyl, HRP, or AP.

Ligands can be proteins, e.g., glycoproteins, or peptides, e.g., molecules having a specific affinity for a co-ligand, or antibodies e.g., an antibody, that binds to a specified cell type such as a hepatic cell. Ligands can include hormones and hormone receptors. They can include non-peptidic species, such as lipids, lectins, carbohydrates, vitamins, cofactors, multivalent lactose, multivalent galactose, N-acetyl-galactosamine, N-acetyl-gulucosamine multivalent mannose, or multivalent fucose.

The ligand can be a substance, e.g., a drug, which can increase the uptake of the oligonucleotide agent into the cell, for example, by disrupting the cell's cytoskeleton, e.g., by disrupting the cell's microtubules, microfilaments, and/or intermediate filaments. The drug can be, for example, taxon, vincrstine, vinblastine, cytochalasin, nocodazole, japlakinolide, latrunculin A, phalloidin, swinholide A, indanocine, or myoservin.

In some aspects, a ligand attached to an oligonucleotide as described herein acts as a pharmacokinetic modulator (PK modulator). PK modulators include lipophiles, bile acids, steroids, phospholipid analogues, peptides, protein binding agents, PEG, vitamins etc. Exemplary PK modulators include, but are not limited to, cholesterol, fatty acids, cholic acid, lithocholic acid, dialkylglycendes, diacylglycende, phospholipids, sphingolipids, naproxen, ibuprofen, vitamin E, biotin etc. Oligonucleotides that comprise a number of phosphorothioate linkages are also known to bind to serum protein, thus short oligonucleotides, e.g., oligonucleotides of about 5 bases, 10 bases, 15 bases, or 20 bases, comprising multiple of phosphorothioate linkages in the backbone are also amenable as ligands (e.g. as PK modulating ligands). In addition, aptamers that bind serum components (e g serum proteins) are also suitable for use as PK modulating ligands in the aspects described herein.

Ligand-conjugated oligonucleotides can be synthesized by the use of an oligonucleotide that bears a pendant reactive functionality, such as that derived from the attachment of a linking molecule onto the oligonucleotide (described below). This reactive oligonucleotide can be reacted directly with commercially-available ligands, ligands that are synthesized bearing any of a variety of protecting groups, or ligands that have a linking moiety attached thereto.

The oligonucleotides used in the conjugates can be conveniently and routinely made through the well-known technique of solid-phase synthesis. Equipment for such synthesis is sold by several vendors including, for example, Applied Biosystems (Foster City, Calif.). Any other means for such synthesis known in the art can additionally or alternatively be employed. It is also known to use similar techniques to prepare other oligonucleotides, such as the phosphorothioates and alkylated derivatives.

In the ligand-conjugated oligonucleotides, such as the ligand-molecule bearing sequence-specific linked nucleosides, the oligonucleotides and oligonucleosides can be assembled on a suitable DNA synthesizer utilizing standard nucleotide or nucleoside precursors, or nucleotide or nucleoside conjugate precursors that already bear the linking moiety, ligand-nucleotide or nucleoside-conjugate precursors that already bear the ligand molecule, or non-nucleoside ligand-bearing building blocks.

When using conjugate precursors that already bear a linking moiety, the synthesis of the sequence-specific linked nucleosides is typically completed, and the ligand molecule is then reacted with the linking moiety to form the ligand-conjugated oligonucleotide. In some aspects, the oligonucleotides or linked nucleosides are synthesized by an automated synthesizer using phosphoramidites derived from ligand-nucleoside conjugates in addition to the standard phosphoramidites and non-standard phosphoramidites that are commercially available and routinely used in oligonucleotide synthesis.

i. Lipid Conjugates

In one aspect, the ligand or conjugate is a lipid or lipid-based molecule. Such a lipid or lipid-based molecule can bind a serum protein, e.g., human serum albumin (HSA). An HSA binding ligand allows for distribution of the conjugate to a target tissue, e.g., a non-kidney target tissue of the body. A lipid or lipid-based ligand can (a) increase resistance to degradation of the conjugate, (b) increase targeting or transport into a target cell or cell membrane, and/or (c) can be used to adjust binding to a serum protein, e.g., HSA.

In another aspect, the ligand is a moiety, e.g., a vitamin, which is taken up by a target cell, e.g., a proliferating cell. Exemplary vitamins include vitamin A, E, and K.

ii. Cell Permeation Agents

In another aspect, the ligand is a cell-permeation agent, such a helical cell-permeation agent. In one aspect, the agent is amphipathic. An exemplary agent is a peptide such as tat or antennopedia. If the agent is a peptide, it can be modified, including a peptidylmimetic, invertomers, non-peptide or pseudo-peptide linkages, and use of D-amino acids. In some aspects, the helical agent is an alpha-helical agent, which can have a lipophilic and a lipophobic phase.

The ligand can be a peptide or peptidomimetic. A peptidomimetic (also referred to herein as an oligopeptidomimetic) is a molecule capable of folding into a defined three-dimensional structure similar to a natural peptide. The attachment of peptide and peptidomimetics to oligonucleotide agents can affect pharmacokinetic distribution of the oligonucleotide, such as by enhancing cellular recognition and absorption. The peptide or peptidomimetic moiety can be about 5-50 amino acids long, e.g., about 5, 10, 15, 20, 25, 30, 35, 40, 45, or 50 amino acids long.

A peptide or peptidomimetic can be, for example, a cell permeation peptide, cationic peptide, amphipathic peptide, or hydrophobic peptide (e.g., consisting primarily of Tyr, Trp, or Phe). The peptide moiety can be a dendrimer peptide, constrained peptide or crosslinked peptide. In another alternative, the peptide moiety can include a hydrophobic membrane translocation sequence (MTS). An exemplary hydrophobic MTS-containing peptide is RFGF having the amino acid sequence AAVALLPAVLLALLAP (SEQ ID NO. 4711). An RFGF analogue (e.g., amino acid sequence AALLPVLLAAP (SEQ ID NO. 4712) containing a hydrophobic MTS can be a targeting moiety. The peptide moiety can be a "delivery" peptide, which can carry large polar molecules including peptides, oligonucleotides, and protein across cell membranes. For example, sequences from the HIV Tat protein (GRKKRRQRRRPPQ (SEQ ID NO: 4713)) and the *Drosophila* Antennapedia protein (RQIKIWFQNRRMKWKK (SEQ ID NO: 4714)) have been found to be capable of functioning as delivery peptides. A peptide or peptidomimetic can be encoded by a random sequence of DNA, such as a peptide identified from a phage-display library, or one-bead-one-compound (OBOC) combinatorial library (Lam et al., Nature, 354:82-84, 1991). Examples of a peptide or peptidomimetic tethered to an oligonucleotide agent via an incorporated monomer unit for cell targeting purposes is an arginine-glycine-aspartic acid (RGD)-peptide, or RGD mimic. A peptide moiety can range in length from about 5 amino acids to about 40 amino acids. The peptide moieties can have a structural modification, such as to increase stability or direct conformational properties. Any of the structural modifications described below can be utilized.

An RGD peptide for use in the compositions and methods can be linear or cyclic, and can be modified, e.g., glycosylated or methylated, to facilitate targeting to a specific tissue(s). RGD-containing peptides and peptidiomimemtics can include D-amino acids, as well as synthetic RGD mimics. In addition to RGD, one can use other moieties that target the integnn ligand. Some conjugates of this ligand target PECAM-1 or VEGF.

A cell permeation peptide is capable of permeating a cell, e.g., a microbial cell, such as a bacterial or fungal cell, or a mammalian cell, such as a human cell. A microbial cell-permeating peptide can be, for example, an α-helical linear peptide (e.g., LL-37 or Ceropin P1), a disulfide bond-containing peptide (e.g., α-defensin, β-defensin, or bactenecin), or a peptide containing only one or two dominating amino acids (e.g., PR-39 or indolicidin). A cell permeation peptide can include a nuclear localization signal (NLS). For example, a cell permeation peptide can be a bipartite amphipathic peptide, such as MPG. which is derived from the fusion peptide domain of HIV-1 gp41 and the NLS of SV40 large T antigen (Simeoni et al, Nucl Acids Res. 31:2717-2724, 2003).

iii. Carbohydrate Conjugates

In some aspects of the compositions and methods described herein, an oligonucleotide further comprises a carbohydrate. The carbohydrate conjugated oligonucleotides are advantageous for the in vivo delivery of nucleic acids, as well as compositions suitable for in vivo therapeutic use, as described herein. As used herein, "carbohydrate" refers to a compound which is either a carbohydrate per se made up of one or more monosaccharide units having at least 6 carbon atoms (which can be linear, branched or cyclic) with an oxygen, nitrogen or sulfur atom bonded to each carbon atom; or a compound having as a part thereof a carbohydrate moiety made up of one or more monosaccharide units each having at least six carbon atoms (which can be linear, branched or cyclic), with an oxygen, nitrogen or sulfur atom bonded to each carbon atom. Representative carbohydrates include the sugars (mono-, di-, tri- and oligosaccharides containing from about 4, 5, 6, 7, 8, or 9 monosaccharide units), and polysaccharides such as starches, glycogen, cellulose and polysaccharide gums. Specific monosaccharides include C5 and above (e.g., C5, C6, C7, or C8) sugars. di- and trisaccharides include sugars having two or three monosaccharide units (e.g., C5, C6, C7, or C8).

In one aspect, a carbohydrate conjugate for use in the compositions and methods described herein is a monosaccharide.

In some aspects, the carbohydrate conjugate further comprises one or more additional ligands as described above, such as, but not limited to, a PK modulator and/or a cell permeation peptide.

Additional carbohydrate conjugates (and linkers) suitable for use include those described in PCT Publication Nos. WO 2014/179620 and WO 2014/179627, the entire contents of each of which are incorporated herein by reference.

iv. Linkers

In some aspects, the conjugate or ligand described herein can be attached to an oligonucleotide with various linkers that can be cleavable or non-cleavable.

Linkers typically comprise a direct bond or an atom such as oxygen or sulfur, a unit such as $NR^8$, C(O), C(O)NH, SO, $SO_2$, $SO_2NH$ or a chain of atoms, such as, but not limited to, substituted or unsubstituted alkyl, substituted or unsubstituted alkenyl, substituted or unsubstituted alkynyl, arylalkyl, arylalkenyl, arylalkynyl, heteroarylalkyl, heteroarylalkenyl, heteroarylalkynyl, heterocydylalkyl, heterocyclylalkenyl, heterocyclylalkynyl, aryl, heteroaryl, heterocyclyl, cycloalkyl, cycloalkenyl, alkylarylalkyl, alkylarylalkenyl, alkylarylalkynyl, alkenylarylalkyl, alkenylarylalkenyl, alkenylarylalkynyl, alkynylarylalkyl, alkynylarylalkenyl, alkynylarylalkynyl, alkylheteroarylalkyl, alkylheteroarylalkenyl, alkylheteroarylalkynyl, alkenylheteroarylalkyl, alkenylheteroarylalkenyl, alkenylheteroarylalkynyl, alkynyl-heteroarylalkyl, alkynylheteroarylalkenyl, alkynylheteroarylalkynyl, alkylheterocyclylalkyl, alkylheterocyclylalkenyl, alkylhererocyclylalkynyl, alkenylheterocyclylalkyl, alkenylheterocyclylalkenyl, alkenylheterocyclylalkynyl, alkynylheterocydylalkyl, alkynylheterocyclylalkenyl, alkynylheterocydylalkynyl, alkylaryl, alkenylaryl, alkynylaryl, alkylheteroaryl, alkenylheteroaryl, alkynylhereroaryl, which one or more methylenes can be interrupted or terminated by O, S, S(O), $SO_2$, $N(R^8)$, C(O), substituted or unsubstituted aryl, substituted or unsubstituted heteroaryl, substituted or unsubstituted heterocyclic; where $R^8$ is hydrogen, acyl, aliphatic or substituted aliphatic. In one aspect, the linker is between about 1-24, 2-24, 3-24, 4-24, 5-24, 6-24, 6-18, 7-18, 8-18, 7-17, 8-17, 6-16, 7-17, 8-16 or 1, 2, 3, 4, 5, 6, 7, 8, 9, 10, 11, 12, 13, 14, 15, 16, 17, 18, 19, 20, 21, 21, 22, 23, or 24 atoms.

A cleavable linking group is one which is sufficiently stable outside the cell, but which upon entry into a target cell is cleaved to release the two parts the linker is holding together. In some aspects, the cleavable linking group is cleaved at least about 10 times, 20, times, 30 times, 40 times, 50 times, 60 times, 70 times, 80 times, 90 times, or more, or at least about 100 times faster in a target cell or under a first reference condition (which can, e.g., be selected to mimic or represent intracellular conditions) than in the blood of a subject, or under a second reference condition (which can, e.g., be selected to mimic or represent conditions found in the blood or serum).

Cleavable linking groups are susceptible to cleavage agents, e.g., pH, redox potential, or the presence of degradative molecules. Generally, cleavage agents are more prevalent or found at higher levels or activities inside cells than in serum or blood. Examples of such degradative agents include: redox agents which are selective for particular substrates or which have no substrate specificity, including, e.g., oxidative or reductive enzymes or reductive agents such as mercaptans, present in cells, that can degrade a redox cleavable linking group by reduction; esterases; endosomes or agents that can create an acidic environment, e.g., those that result in a pH of five or lower; enzymes that can hydrolyze or degrade an acid cleavable linking group by acting as a general acid, peptidases (which can be substrate specific), and phosphatases.

A cleavable linkage group, such as a disulfide bond can be susceptible to pH. The pH of human serum is 7.4, while the average intracellular pH is slightly lower, ranging from about 7.1-7 3. Endosomes have a more acidic pH, in the range of 5.5-6.0, and lysosomes have an even more acidic pH at around 5.0. Some linkers will have a cleavable linking group that is cleaved at a preferred pH, thereby releasing a cationic lipid from the ligand inside the cell, or into the desired compartment of the cell.

A linker can include a cleavable linking group that is cleavable by a particular enzyme. The type of cleavable linking group incorporated into a linker can depend on the cell to be targeted. For example, a liver-targeting ligand can be linked to a cationic lipid through a linker that includes an ester group Liver cells are rich in esterases, and therefore the linker will be cleaved more efficiently in liver cells than in cell types that are not esterase-rich. Other cell-types rich in esterases include cells of the lung, renal cortex, and testis.

Linkers that contain peptide bonds can be used when targeting cell types rich in peptidases, such as liver cells and synoviocytes.

In general, the suitability of a candidate cleavable linking group can be evaluated by testing the ability of a degradative agent (or condition) to cleave the candidate linking group. It will also be desirable to test the candidate cleavable linking group for the ability to resist cleavage in the blood or when in contact with other non-target tissue. Thus, one can determine the relative susceptibility to cleavage between at least two conditions, where at least one condition is selected to be indicative of cleavage in a target cell and another conditions is selected to be indicative of cleavage in other tissues or biological fluids, e.g., blood or serum. The evaluations can be carried out in cell free systems, in cells, in cell culture, in organ or tissue culture, or in whole animals. It can be useful to make initial evaluations in cell-free or culture conditions and to confirm by further evaluations in whole animals. In some aspects, useful candidate compounds are cleaved at least about 2, 4, 10, 20, 30, 40, 50, 60, 70, 80, 90, or 100 times faster in the cell (or under in vitro conditions selected to mimic intracellular conditions) as compared to blood or serum (or under in vitro conditions selected to mimic extracellular conditions).

a Redox Cleavable Linking Groups

In one aspect, a cleavable linking group is a redox cleavable linking group that is cleaved upon reduction or oxidation. An example of reductively cleavable linking group is a disulphide linking group (—S—S—). To determine if a candidate cleavable linking group is a suitable "reductively cleavable linking group," or for example is suitable for use with a particular oligonucleotide moiety and particular targeting agent one can look to methods described herein. For example, a candidate can be evaluated by incubation with dithiothreitol (DTT), or other reducing agent using reagents know in the art, which mimic the rate of cleavage which would be observed in a cell, e.g., a target cell. The candidates can be evaluated under conditions which are selected to mimic blood or serum conditions. In one aspect, candidate compounds are cleaved by at most about 10% in the blood. In other aspects, useful candidate compounds are degraded at least about 2, 4, 10, 20, 30, 40, 50, 60, 70, 80, 90, or 100 times faster in the cell (or under in vitro conditions selected to mimic intracellular conditions) as compared to blood (or under in vitro conditions selected to mimic extracellular conditions). The rate of cleavage of candidate compounds can be determined using standard enzyme kinetics assays under conditions chosen to mimic intracellular media and compared to conditions chosen to mimic extracellular media.

b. Phosphate-Based Cleavable Linking Groups

In another aspect, a cleavable linker comprises a phosphate-based cleavable linking group. A phosphate-based cleavable linking group is cleaved by agents that degrade or hydrolyze the phosphate group. An example of an agent that cleaves phosphate groups in cells are enzymes such as phosphatases in cells. Examples of phosphate-based linking groups are $—O—P(O)OR^k)—O—$, $—O—P(S)(OR^k)—O—$, $—O—P(S)(SR^k)—O—$, $—S—P(O)(OR^k)—S—$, $—O—P(O)(OR^k)—S—$, $—S—P(O)(OR^k)—S—O—P(S)(OR^k)—S—$, $—S—P(S)(OR^k)—O—$, $—O—P(O)(R^k)—O—$, $—O—P(S)(R^k)—O—$, $—S—P(O)(R^k)—O—$, $—S—P(S)(R^k)—O—$, $—S—P(OXR^k)—S—$, $—O—P(S)R^k)—S—$. These candidates can be evaluated using methods analogous to those described above.

c. Acid Cleavable Linking Groups

In another aspect, a cleavable linker comprises an acid cleavable linking group. An acid cleavable linking group is a linking group that is cleaved under acidic conditions. In some aspects, acid cleavable linking groups are cleaved in an acidic environment with a pH of about 6.5 or lower (e.g., about 6.0, 5.75, 5.5, 5.25, 5.0, or lower), or by agents such as enzymes that can act as a general acid. In a cell, specific low pH organelles, such as endosomes and lysosomes can provide a cleaving environment for acid cleavable linking groups. Examples of acid cleavable linking groups include but are not limited to hydrazones, esters, and esters of amino acids. Acid cleavable groups can have the general formula —C═NN—, C(O)O, or —OC(O). In one aspect, the carbon is attached to the oxygen of the ester (the alkoxy group) is an aryl group, substituted alkyl group, or tertiary alkyl group such as dimethyl pentyl or t-butyl. These candidates can be evaluated using methods analogous to those described above.

d. Ester-Based Linking Groups

In another aspect, a cleavable linker comprises an ester-based cleavable linking group. An ester-based cleavable linking group is cleaved by enzymes such as esterases and amidases in cells. Examples of ester-based cleavable linking groups include but are not limited to esters of alkylene, alkenylene and alkynylene groups. Ester cleavable linking groups have the general formula —C(O)O—, or —OC(O)— These candidates can be evaluated using methods analogous to those described above.

e. Peptide-Based Cleaving Groups

In yet another aspect, a cleavable linker comprises a peptide-based cleavable linking group. A peptide-based cleavable linking group is cleaved by enzymes such as peptidases and proteases in cells. Peptide-based cleavable linking groups are peptide bonds formed between amino acids to yield oligopeptides (e.g., dipeptides, tripeptides etc.) and polypeptides. Peptide-based cleavable groups do not include the amide group (—C(O)NH—). The amide group can be formed between any alkylene, alkenylene, or alkynelene. A peptide bond is a special type of amide bond formed between amino acids to yield peptides and proteins. The peptide based cleavage group is generally limited to the peptide bond (i.e., the amide bond) formed between amino acids yielding peptides and proteins and does not include the entire amide functional group. Peptide-based cleavable linking groups have the general formula —NHCHR$^A$C(O)NHCHR$^B$C(O)—, where R$^A$ and R$^B$ are the R groups of the two adjacent amino acids. These candidates can be evaluated using methods analogous to those described above.

In one aspect, an oligonucleotide is conjugated to a carbohydrate through a linker. Linkers include bivalent and trivalent branched linker groups. Linkers for oligonucleotide carbohydrate conjugates include, but are not limited to, those described in formulas 24-35 of PCT Publication No WO 2018/195165.

Representative U.S. patents that teach the preparation of oligonucleotide conjugates include, but are not limited to, U.S. Pat. Nos. 4,828,979; 4,948,882; 5,218,105; 5,525,465; 5,541,313; 5,545,730; 5,552,538, 5,578,717, 5,580,731, 5,591,584; 5,109,124, 5,118,802; 5,138,045, 5,414,077; 5,486,603, 5,512,439; 5,578,718, 5,608,046; 4,587,044; 4,605,735; 4,667,025, 4,762,779; 4,789,737, 4,824,941; 4,835,263, 4,876,335; 4,904,582, 4,958,013; 5,082,830, 5,112,963; 5,214,136, 5,082,830; 5,112,963; 5,214,136; 5,245,022, 5,254,469; 5,258,506; 5,262,536; 5,272,250; 5,292,873; 5,317,098, 5,371,241, 5,391,723; 5,416,203, 5,451,463; 5,510,475; 5,512,667; 5,514,785; 5,565,552; 5,567,810; 5,574,142; 5,585,481; 5,587,371. 5,595,726; 5,597,696; 5,599,923; 5,599,928 and 5,688,941; 6,294,664; 6,320,017; 6,576,752; 6,783,931; 6,900,297; 7,037,646; 8,106,022, the entire contents of each of which are hereby incorporated herein by reference.

It is not necessary for all positions in a given compound to be uniformly modified, and in fact more than one of the aforementioned modifications can be incorporated in a single compound or even at a single nucleoside within an oligonucleotide. Oligonucleotide compounds that are chimeric compounds are also contemplated. Chimeric oligonucleotides typically contain at least one region wherein the RNA is modified so as to confer upon the oligonucleotide increased resistance to nuclease degradation, increased cellular uptake, and/or increased binding affinity for the target nucleic acid. An additional region of the oligonucleotide can serve as a substrate for enzymes capable of cleaving RNA:DNA By way of example, RNase H is a cellular endonuclease which cleaves the RNA strand of an RNA-DNA duplex Activation of RNase H, therefore, results in cleavage of the RNA target, thereby greatly enhancing the efficiency of oligonucleotide inhibition of gene expression. Consequently, comparable results can often be obtained with shorter oligonucleotides when chimeric oligonucleotides are used, compared to phosphorothioate deoxy oligonucleotides hybridizing to the same target region. Cleavage of the RNA target can be routinely detected by gel electrophoresis and, if necessary, associated nucleic acid hybridization techniques known in the art.

In certain instances, the nucleotides of an oligonucleotide can be modified by a non-ligand group. A number of non-ligand molecules have been conjugated to oligonucleotides in order to enhance the activity, cellular distribution, or cellular uptake of the oligonucleotide, and procedures for performing such conjugations are available in the scientific literature Such non-ligand moieties have included lipid moieties, such as cholesterol (Kubo, T. et al., Biochem. Biophys. Res Comm, 2007, 365(1):54-61; Letsinger et al., Proc. Nati. Acad Sci. USA, 1989, 86:6553), cholic acid (Manoharan et al., Bioorg. Med. Chem. Lett., 1994, 4-1053), a thioether, e.g., hexyl-S-tritylthiol (Manoharan et al., Ann. N Y. Acad. Sci., 1992, 660-306: Manoharan et al., Bioorg. Med Chem. Let, 1993, 3:2765), a thiocholesterol (Oberhauser et al., Nucl. Acids Res., 1992, 20.533), an aliphatic chain, e.g., dodecandiol or undecyl residues (Saison-Behmoaras et al., EMBO J., 1991, 10:111; Kabanov et al., FEBS Lett, 1990, 259:327, Svinarchuk et al., Biochimie, 1993, 75:49), a phospholipid, e.g., di-hexadecyl-rac-glycerol ortriethylammonium 1,2-di-O-hexadecyl-rac-glycero-3-H-phosphonate (Manoharan et al., Tetrahedron Lett., 1995, 36:3651; Shea et al., Nucl. Acids Res., 1990, 18:3777), a polyamine or a polyethylene glycol chain (Manoharan et al., Nucleosides & Nuclectides, 1995, 14:969), or adamantane acetic acid (Manoharan et al., Tetrahedron Lett., 1995, 36:3651), a palmityl moiety (Mishra et al., Biochim. Biophys Acta, 1995, 1264:229), or an octadecylamine or hexylamino-carbonyl-oxycholesterol moiety (Crooke et al., J. Pharmacol. Exp. Ther., 1996, 277:923). Representative United States patents that teach the preparation of such oligonucleotide conjugates have been listed above. Typical conjugation protocols involve the synthesis of an oligonucleotide bearing an aminolinker at one or more positions of the sequence. The amino group is then reacted with the molecule being conjugated using appropriate coupling or activating reagents. The conjugation reaction can be performed either with the oligonucleotide still bound to the solid support or following cleavage of the oligonucleotide, in solution phase. Purification of the oligonucleotide conjugate by HPLC typically affords the pure conjugate.

IV. Pharmaceutical Uses

The oligonucleotide compositions described herein are useful in the methods described herein, and, while not bound by theory, are believed to exert their desirable effects through their ability to modulate the level, status, and/or activity of a MutLγ heterodimer comprising MLH3, e.g., by inhibiting the activity or level of the MLH3 protein in a cell in a mammal.

An aspect relates to methods of treating disorders related to DNA mismatch repair such as trinucleotide repeat expansion disorders in a subject in need thereof. Another aspect includes reducing the level of MLH3 in a cell of a subject identified as having a trinucleotide repeat expansion disorder. Still another aspect includes a method of inhibiting expression of MLH3 in a cell in a subject. Further aspects include methods of decreasing trinucleotide repeat expansion in a cell. The methods include contacting a cell with an oligonucleotide, in an amount effective to inhibit expression of MLH3 in the cell, thereby inhibiting expression of MLH3 in the cell.

Based on the above methods, an oligonucleotide described herein, or a composition comprising such an oligonucleotide, for use in therapy, or for use as a medicament, or for use in treating disorders related to DNA mismatch repair such as trinucleotide repeat expansion disorders in a subject in need thereof, or for use in reducing the level of MLH3 in a cell of a subject identified as having a trinucleotide repeat expansion disorder, or for use in inhibiting expression of MLH3 in a cell in a subject, or for use in decreasing trinucleotide repeat expansion in a cell is contemplated. The uses include the contacting of a cell with the oligonucleotide, in an amount effective to inhibit expression of MLH3 in the cell, thereby inhibiting expression of MLH3 in the cell Aspects described below in relation to the methods described herein are also applicable to these further aspects.

Contacting of a cell with an oligonucleotide can be done in vitro or in vivo. Contacting a cell in vivo with the oligonucleotide includes contacting a cell or group of cells within a subject, e.g., a human subject, with the oligonucleotide. Combinations of in vitro and in vivo methods of contacting a cell are also possible. Contacting a cell can be direct or indirect, as discussed above. Furthermore, contacting a cell can be accomplished via a targeting ligand, including any ligand described herein or known in the art. In some aspects, the targeting ligand is a carbohydrate moiety, e.g., a GalNAc3 ligand, or any other ligand that directs the oligonucleotide to a site of interest. Cells can include those of the central nervous system, or muscle cells.

Inhibiting expression of a MLH3 gene includes any level of inhibition of a MLH3 gene, e.g., at least partial suppression of the expression of a MLH3 gene, such as an inhibition by at least about 20%. In some aspects, inhibition is by at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99%.

The expression of a MLH3 gene can be assessed based on the level of any variable associated with MLH3 gene expression, e.g., MLH3 mRNA level or MLH3 protein level.

Inhibition can be assessed by a decrease in an absolute or relative level of one or more of these variables compared with a control level. The control level can be any type of control level that is utilized in the art, e.g., a pre-dose baseline level, or a level determined from a similar subject, cell, or sample that is untreated or treated with a control (such as, e.g., buffer only control or inactive agent control).

In some aspects, surrogate markers can be used to detect inhibition of MLH3. For example, effective treatment of a trinucleotide repeat expansion disorder, as demonstrated by acceptable diagnostic and monitoring criteria with an agent to reduce MLH3 expression can be understood to demonstrate a clinically relevant reduction in MLH3.

In some aspects of the methods described herein, expression of a MLH3 gene is inhibited by at least 20%, 25%, 30%, 35%, 40%, 45%, 50%, 55%, 60%, 65%, 70%, 75%, 80%, 85%, 90%, or 95%, or to below the level of detection of the assay. In some aspects, the methods include a clinically relevant inhibition of expression of MLH3, e.g., as demonstrated by a clinically relevant outcome after treatment of a subject with an agent to reduce the expression of MLH3.

Inhibition of the expression of a MLH3 gene can be manifested by a reduction of the amount of mRNA expressed by a first cell or group of cells (such cells can be present, for example, in a sample derived from a subject) in which a MLH3 gene is transcribed and which has or have been treated (e.g., by contacting the cell or cells with an oligonucleotide, or by administering an oligonucleotide to a subject in which the cells are or were present) such that the expression of a MLH3 gene is inhibited, as compared to a second cell or group of cells substantially identical to the first cell or group of cells but which has not or have not been so treated (control cell(s) not treated with an oligonucleotide or not treated with an oligonucleotide targeted to the gene of interest). The degree of inhibition can be expressed in terms of:

$$\frac{(\text{mRNA in control cells}) - (\text{mRNA in treated cells})}{(\text{mRNA in control cells})} \times 100\%$$

In other aspects, inhibition of the expression of a MLH3 gene can be assessed in terms of a reduction of a parameter that is functionally linked to MLH3 gene expression, e.g., MLH3 protein expression or MLH3 signaling pathways. MLH3 gene silencing can be determined in any cell expressing MLH3, either endogenous or heterologous from an expression construct, and by any assay known in the art.

Inhibition of the expression of a MLH3 protein can be manifested by a reduction in the level of the MLH3 protein that is expressed by a cell or group of cells (e.g., the level of protein expressed in a sample derived from a subject) As explained above, for the assessment of mRNA suppression, the inhibition of protein expression levels in a treated cell or group of cells can similarly be expressed as a percentage of the level of protein in a control cell or group of cells.

A control cell or group of cells that can be used to assess the inhibition of the expression of a MLH3 gene includes a cell or group of cells that has not yet been contacted with an oligonucleotide described herein. For example, the control cell or group of cells can be derived from an individual subject (e.g., a human or animal subject) prior to treatment of the subject with an oligonucleotide.

The level of MLH3 mRNA that is expressed by a cell or group of cells can be determined using any method known in the art for assessing mRNA expression. In one aspect, the level of expression of MLH3 in a sample is determined by detecting a transcribed polynucleotide, or portion thereof, e.g., mRNA of the MLH3 gene RNA can be extracted from cells using RNA extraction techniques including, for example, using acid phenol/guanidine isothiocyanate extraction (RNAzoI B; Biogenesis), RNEASY™ RNA preparation kits (Qiagen) or PAXgene (PreAnalytix, Switzerland). Typical assay formats utilizing ribonucleic acid hybridization include nuclear run-on assays, RT-PCR, RNase protection assays, northern blotting, in situ hybridization, and microarray analysis. Circulating MLH3 mRNA can be detected using methods the described in PCT Publication WO2012/177906, the entire contents of which are hereby incorporated herein by reference. In some aspects, the level of expression of MLH3 is determined using a nucleic acid probe. The term "probe," as used herein, refers to any molecule that is capable of selectively binding to a specific MLH3 sequence, e.g. to an mRNA or polypeptide. Probes can be synthesized by one of skill in the art, or derived from appropriate biological preparations. Probes can be specifically designed to be labeled. Examples of molecules that can be utilized as probes include, but are not limited to, RNA, DNA, proteins, antibodies, and organic molecules.

Isolated mRNA can be used in hybridization or amplification assays that include, but are not limited to, Southern or northern analyses, polymerase chain reaction (PCR) analyses, and probe arrays. One method for the determination of mRNA levels involves contacting the isolated mRNA with a nucleic acid molecule (probe) that can hybridize to MLH3 mRNA. In one aspect, the mRNA is immobilized on a solid surface and contacted with a probe, for example by running the isolated mRNA on an agarose gel and transferring the mRNA from the gel to a membrane, such as nitrocellulose. In an alternative aspect, the probe(s) are immobilized on a solid surface and the mRNA is contacted with the probe(s), for example, in an AFFYMETRIX gene chip array A skilled artisan can readily adapt known mRNA detection methods for use in determining the level of MLH3 mRNA.

An alternative method for determining the level of expression of MLH3 in a sample involves the process of nucleic acid amplification and/or reverse transcriptase (to prepare cDNA) of for example mRNA in the sample, e.g., by RT-PCR (the experimental aspect set forth in Mullis, 1987, U.S. Pat. No. 4,683,202), ligase chain reaction (Barany (1991) Proc. Natl. Acad. Sci. USA 88:189-193), self-sustained sequence replication (Guatelli et al. (1990) Proc. Natl Acad Sci. USA 87:1874-1878), transcriptional amplification system (Kwoh et al. (1989) Proc Nati. Acad. Sci. USA 86:1173-1177), Q-Beta Replicase (Lizardi et al. (1988) Bio/Technology 6:1197), rolling circle replication (Lizardi et al., U.S. Pat. No. 5,854,033) or any other nucleic acid amplification method, followed by the detection of the amplified molecules using techniques well known to those of skill in the art. These detection schemes are especially useful for the detection of nucleic acid molecules if such molecules are present in very low numbers. In some aspects, the level of expression of MLH3 is determined by quantitative fluorogenic RT-PCR (i e., the TAQMAN™ System) or the DUAL-GLO® Luciferase assay.

The expression levels of MLH3 mRNA can be monitored using a membrane blot (such as used in hybridization analysis such as northern, Southern, dot, and the like), or microwells, sample tubes, gels, beads or fibers (or any solid support comprising bound nucleic acids). See U.S. Pat. Nos. 5,770,722; 5,874,219; 5,744,305, 5,677,195; and 5,445,934, which are incorporated herein by reference. The determination of MLH3 expression level can comprise using nucleic acid probes in solution.

In some aspects, the level of mRNA expression is assessed using branched DNA (bDNA) assays or real time PCR (qPCR). The use of this PCR method is described and exemplified in the Examples presented herein. Such methods can be used for the detection of MLH3 nucleic acids.

The level of MLH3 protein expression can be determined using any method known in the art for the measurement of protein levels. Such methods include, for example, electrophoresis, capillary electrophoresis, high performance liquid chromatography (HPLC), thin layer chromatography (TLC), hyperdiffusion chromatography, fluid or gel precipitin reactions, absorption spectroscopy, a colorimetric assays, spectrophotometric assays, flow cytometry, immunodiffusion (single or double), immunoeledrophoresis, western blotting, radioimmunoassay (RIA), enzyme-linked immunosorbent assays (ELISAs), immunofluorescent assays, electrochemiluminescence assays, and the like. Such assays can be used for the detection of proteins indicative of the presence or replication of MLH3 proteins.

In some aspects of the methods described herein, the oligonucleotide is administered to a subject such that the oligonucleotide is delivered to a specific site within the subject. The inhibition of expression of MLH3 can be assessed using measurements of the level or change in the level of MLH3 mRNA or MLH3 protein in a sample derived from a specific site within the subject. In some aspects, the methods include a clinically relevant inhibition of expression of MLH3, e.g., as demonstrated by a clinically relevant outcome after treatment of a subject with an agent to reduce the expression of MLH3.

In other aspects, the oligonucleotide is administered in an amount and for a time effective to result in one of (or more, e.g., two or more, three or more, four or more of): (a) decrease the number of trinucleotide repeats, (b) decrease the level of polyglutamine, (c) decreased cell death (e.g., CNS cell death and/or muscle cell death), (d) delayed onset of the disorder, (e) increased survival of subject, and (f) increased progression free survival of a subject.

Treating trinucleotide repeat expansion disorders can result in an increase in average survival time of an individual or a population of subjects treated with an oligonucleotide described herein in comparison to a population of untreated subjects. For example, the survival time of an individual or average survival time of a population is increased by more than 30 days (more than 60 days, 90 days, or 120 days). An increase in survival time of an individual or in average survival time of a population can be measured by any reproducible means. An increase in survival time of an individual can be measured, for example, by calculating for an individual the length of survival time following the initiation of treatment with the compound described herein. An increase in average survival time of a population can be measured, for example, by calculating for the average length of survival time following initiation of treatment with the compound described herein. An increase in survival time of an individual can be measured, for example, by calculating for an individual length of survival time following completion of a first round of treatment with a compound or pharmaceutically acceptable salt of a compound described herein. An increase in average survival time of a population can be measured, for example, by calculating for a population the average length of survival time following completion of a first round of treatment with a compound or pharmaceutically acceptable salt of a compound described herein.

Treating trinucleotide repeat expansion disorders can result in a decrease in the mortality rate of a population of treated subjects in comparison to an untreated population. For example, the mortality rate is decreased by more than 2% (e.g., more than 5%, 10%, or 25%). A decrease in the mortality rate of a population of treated subjects can be measured by any reproducible means, for example, by calculating for a population the average number of disease-related deaths per unit time following initiation of treatment with a compound or pharmaceutically acceptable salt of a compound described herein. A decrease in the mortality rate of a population can be measured, for example, by calculating for a population the average number of disease-related deaths per unit time following completion of a first round of treatment with a compound or pharmaceutically acceptable salt of a compound described herein.

A. Delivery of Anti-MLH3 Agents

The delivery of an oligonucleotide to a cell e.g., a cell within a subject, such as a human subject e.g., a subject in need thereof, such as a subject having a trinucleotide repeat expansion disorder can be achieved in a number of different ways. For example, delivery can be performed by contacting a cell with an oligonucleotide described herein either in vitro or in vivo. In vivo delivery can be performed directly by administering a composition comprising an oligonucleotide to a subject. These alternatives are discussed further below.

In general, any method of delivering a nucleic acid molecule (in vitro or in vivo) can be adapted for use with an oligonucleotide (see e.g., Akhtar S and Julian R L, (1992) Trends Cell. Biol. 2(5):139-144 and WO94/02595, which are incorporated herein by reference in their entireties). For in vivo delivery, factors to consider in order to deliver an oligonucleotide molecule include, for example, biological stability of the delivered molecule, prevention of non-specific effects, and accumulation of the delivered molecule in the target tissue. The non-specific effects of an oligonucleotide can be minimized by local administration, for example, by direct injection or implantation into a tissue or topically administering the preparation. Local administration to a treatment site maximizes local concentration of the agent, limits the exposure of the agent to systemic tissues that can otherwise be harmed by the agent or that can degrade the agent, and permits a lower total dose of the oligonucleotide to be administered.

For administering an oligonucleotide systemically for the treatment of a disease, the oligonucleotide can include alternative nucleobases, alternative sugar moieties, and/or alternative internucleoside linkages, or alternatively delivered using a drug delivery system; both methods act to prevent the rapid degradation of the oligonucleotide by endo- and exo-nucleases in vivo. Modification of the oligonucleotide or the pharmaceutical carrier can permit targeting of the oligonucleotide composition to the target tissue and avoid undesirable off-target effects. Oligonucleotide molecules can be modified by chemical conjugation to lipophilic groups such as cholesterol to enhance cellular uptake and prevent degradation. In an alternative aspect, the oligonucleotide can be delivered using drug delivery systems such as a nanoparticle, a lipid nanoparticle, a polyplex nanoparticle, a lipoplex nanoparticle, a dendrimer, a polymer, liposomes, or a cationic delivery system. Positively charged cationic delivery systems facilitate binding of an oligonucleotide molecule (negatively charged) and also enhance interactions at the negatively charged cell membrane to permit efficient uptake of an oligonucleotide by the cell. Cationic lipids, dendrimers, or polymers can either be bound to an oligonucleotide, or induced to form a vesicle or micelle that encases an oligonucleotide. The formation of vesicles or micelles further prevents degradation of the oligonucleotide when administered systemically. In general, any methods of delivery of nucleic acids known in the art can be adaptable to the delivery of the oligonucleotides described herein. Methods for making and administering cationic oligonucleotide complexes are well within the abilities of one skilled in the art (see e.g., Sorensen, D R., et al. (2003) J. Mol. Biol 327:761-766; Verma, U N. et al., (2003) Clin. Cancer Res. 9:1291-1300; Arnold, A S et al., (2007) J. Hypertens. 25:197-205, which are incorporated herein by reference in their entirety). Some non-limiting examples of drug delivery systems useful for systemic delivery of oligonucleotides include DOTAP (Sorensen, D R., et al (2003), supra; Verma, U N. et al., (2003), supra), Oligofectamine, "solid nucleic acid lipid particles" (Zimmermann, T S. et al., (2006) Nature 441:111-114), cardiolipin (Chien, P Y. et al., (2005) Cancer Gene Ther. 12:321-328. Pal, A. et al., (2005) Int J. Oncol. 26:1087-1091), polyethyleneimine (Bonnet M E. et al., (2008) Pharm. Res. August 16 Epub ahead of print; Aigner, A (2006) J. Biomed. Biotechnol. 71659), Arg-Gly-Asp (RGD) peptides (Liu, S. (2006) Mol. Pharm 3:472-487), and polyamidoamines (Tomalia, D A. et al., (2007) Biochem. Soc. Trans. 35:61-67; Yoo, H. et al., (1999) Pharm. Res. 16:1799-1804). In some aspects, an oligonucleotide forms a complex with cydodextrin for systemic administration Methods for administration and pharmaceutical compositions of oligonucleotides and cyclodextrins can be found in U.S. Pat. No. 7,427,605, which is herein incorporated by reference in its entirety. In some aspects, the oligonucleotides described herein are delivered by polyplex or lipoplex nanoparticles. Methods for administration and pharmaceutical compositions of oligonucleotides and polyplex nanopartides and lipoplex nanoparticles can be found in U.S. Patent Application Nos. 2017/0121454; 2016/0369269; 2016/0279256, 2016/0251478; 2016/0230189; 2015/0335764, 2015/0307554; 2015/0174549; 2014/0342003; 2014/0135376; and 2013/0317086, which are herein incorporated by reference in their entirety.

i. Membranous Molecular Assembly Delivery Methods

The oligonucleotides can be delivered using a variety of membranous molecular assembly delivery methods including polymeric, biodegradable microparticle, or microcapsule delivery devices known in the art. For example, a colloidal dispersion system can be used for targeted delivery of an oligonucleotide agent described herein Colloidal dispersion systems include macromolecule complexes, nanocapsules, microspheres, beads, and lipid-based systems including oil-in-water emulsions, micelles, mixed micelles, and liposomes. Liposomes are artificial membrane vesicles that are useful as delivery vehicles in vitro and in vivo. It has been shown that large unilamellar vesicles (LUV), which range in size from 0.2-4.0 μm can encapsulate a substantial percentage of an aqueous buffer containing large macromolecules. Liposomes are useful for the transfer and delivery of active ingredients to the site of action. Because the liposomal membrane is structurally similar to biological membranes, when liposomes are applied to a tissue, the liposomal bilayer fuses with bilayer of the cellular membranes. As the merging of the liposome and cell progresses, the internal aqueous contents that include the oligonucleotide are delivered into the cell where the oligonucleotide can specifically bind to a target RNA and can mediate RNase H-mediated gene silencing. In some cases, the liposomes are also specifically targeted, e.g., to direct the oligonucleotide to particular cell types. The composition of the liposome is usually a combination of phospholipids, usually in combination with steroids, especially cholesterol. Other phospholipids or other lipids can be used. The physical characteristics of liposomes depend on pH, ionic strength, and the presence of divalent cations.

A liposome containing an oligonucleotide can be prepared by a variety of methods. In one example, the lipid component of a liposome is dissolved in a detergent so that micelles are formed with the lipid component. For example, the lipid component can be an amphipathic cationic lipid or lipid conjugate. The detergent can have a high critical micelle concentration and can be nonionic Exemplary detergents include cholate, CHAPS, octylglucoside, deoxycholate, and lauroyl sarcosine. The oligonucleotide preparation is then added to the micelles that include the lipid component. The cationic groups on the lipid interact with the oligonucleotide and condense around the oligonucleotide to form a liposome. After condensation, the detergent is removed, e.g., by dialysis, to yield a liposomal preparation of oligonucleotide.

If necessary, a carrier compound that assists in condensation can be added during the condensation reaction, e.g., by controlled addition. For example, the carrier compound can be a polymer other than a nucleic acid (e.g., spermine or spermidine). The pH can be adjusted to favor condensation.

Methods for producing stable polynucleotide delivery vehicles, which incorporate a polynucleotide/cationic lipid complex as a structural component of the delivery vehicle, are further described in, e.g., WO 96/37194, the entire contents of which are incorporated herein by reference. Liposome formation can include one or more aspects of exemplary methods described in Feigner, P. L et al., (1987) Proc. Natl. Acad. Sci. USA 8:7413-7417; U.S. Pat. No. 4,897,355. U.S. Pat. No. 5,171,678; Bangham et al., (1965) M. Mol. Biol. 23:238, Olson et al., (1979) Biochim. Biophys. Acta 557:9; Szoka et al., (1978) Proc. Natl. Acad. Sci. 75: 4194, Mayhew et al., (1984) Biochim. Biophys. Acta 775:169; Kim et al., (1983) Biochim. Biophys. Acta 728: 339; and Fukunaga et al., (1984) Endocrinol. 115:757. Commonly used techniques for preparing lipid aggregates of appropriate size for use as delivery vehicles include sonication and freeze-thaw plus extrusion (see, e.g., Mayer et al., (1986) Biochim. Biophys. Acta 858:161. Microfluidization can be used when consistently small (50 to 200 nm) and relatively uniform aggregates are desired (Mayhew et al., (1984) Biochim. Biophys. Acta 775:169). These methods are readily adapted to packaging oligonucleotide preparations into liposomes.

Liposomes fall into two broad classes. Cationic liposomes are positively charged liposomes which interact with the negatively charged nucleic acid molecules to form a stable complex. The positively charged nucleic acid/liposome complex binds to the negatively charged cell surface and is internalized in an endosome. Due to the acidic pH within the endosome, the liposomes are ruptured, releasing their contents into the cell cytoplasm (Wang et al. (1987) Biochem. Biophys. Res. Commun., 147:980-985).

Liposomes, which are pH-sensitive or negatively charged, entrap nucleic acids rather than complex with them. Since both the nucleic acid and the lipid are similarly charged, repulsion rather than complex formation occurs. Nevertheless, some nucleic acid is entrapped within the aqueous interior of these liposomes. pH sensitive liposomes have been used to deliver nucleic acids encoding the thymidine kinase gene to cell monolayers in culture. Expression of the exogenous gene was detected in the target cells (Zhou et al. (1992) Journal of Controlled Release, 19:269-274).

One major type of liposomal composition includes phospholipids other than naturally-derived phosphatidylcholine. Neutral liposome compositions, for example, can be formed from dimyristoyl phosphatidylcholine (DMPC) or dipalmitoyl phosphatidylcholine (DPPC). Anionic liposome compositions generally are formed from dimyristoyl phosphatidylglycerol, while anionic fusogenic liposomes are formed primarily from dioleoyl phosphatidylethanolamine (DOPE). Another type of liposomal composition is formed from phosphatidylcholine (PC) such as, for example, soybean PC, and egg PC. Another type is formed from mixtures of phospholipid and/or phosphatidylcholine and/or cholesterol.

Examples of other methods to introduce liposomes into cells in vitro and in vivo include U.S. Pat. Nos. 5,283,185; 5,171,678; WO 94/00569; WO 93/24640; WO 91/16024; Feigner, (1994) J Biol Chem. 269:2550; Nabel, (1993) Proc. Natl. Acad. Sci. 90:11307; Nabel, (1992) Human Gene Ther 3:649; Gershon, (1993) Biochem. 32:7143; and Strauss, (1992) EMBO J. 11:417.

Non-ionic liposomal systems have also been examined to determine their utility in the delivery of drugs to the skin, in particular systems comprising non-ionic surfactant and cholesterol. Non-ionic liposomal formulations comprising NOVASOME™ I (glyceryl dilaurate/cholesteroVpolyoxyethylene-10-stearyl ether) and NOVASOME™ II (glyceryl distearate/cholesterol/polyoxyethylene-10-stearyl ether) were used to deliver cyclosporin-A into the dermis of mouse skin. Results indicated that such non-ionic liposomal systems were effective in facilitating the deposition of cydosporine A into different layers of the skin (Hu et al., (1994) S.T.P.Pharma. Sci., 4(6):466).

Liposomes can be sterically stabilized liposomes, comprising one or more specialized lipids that result in enhanced circulation lifetimes relative to liposomes lacking such specialized lipids. Examples of sterically stabilized liposomes are those in which part of the vesicle-forming lipid portion of the liposome (A) comprises one or more glycolipids, such as monosialoganglioside GM1, or (B) is derivatized with one or more hydrophilic polymers, such as a polyethylene glycol (PEG) moiety. While not wishing to be bound by any particular theory, it is thought in the art that, at least for sterically stabilized liposomes containing gangliosides, sphingomyelin, or PEG-derivatized lipids, the enhanced circulation half-life of these sterically stabilized liposomes derives from a reduced uptake into cells of the reticuloendothelial system (RES) (Allen et al., (1987) FEBS Letters, 223:42; Wu et al., (1993) Cancer Research, 53:3765).

Various liposomes comprising one or more glycolipids are known in the art. Papahadjopoulos et al. (Ann. N.Y. Acad. Sci., (1987), 507:64) reported the ability of monosialoganglioside $G^{M1}$, galactocerebroside sulfate, and phosphatidylinositol to improve blood half-lives of liposomes. These findings were expounded upon by Gabizon et al. (Proc. Natl. Acad. Sci. U.S.A., (1988), 85:6949). U.S. Pat. No. 4,837,028 and WO 88/04924, both to Allen et al, disclose liposomes comprising (1) sphingomyelin and (2) the ganglioside GM1 or a galactocerebroside sulfate ester U.S. Pat. No. 5,543,152 (Webb et al.) discloses liposomes comprising sphingomyelin. Liposomes comprising 1,2-sn-dimyristoylphosphatidylcholine are disclosed in WO 97/13499 (Lim et al)

In one aspect, cationic liposomes are used. Cationic liposomes possess the advantage of being able to fuse to the cell membrane. Non-cationic liposomes, although not able to fuse as efficiently with the plasma membrane, are taken up by macrophages in vivo and can be used to deliver oligonucleotides to macrophages.

Further advantages of liposomes include, liposomes obtained from natural phospholipids are biocompatible and biodegradable; liposomes can incorporate a wide range of water and lipid soluble drugs; liposomes can protect encapsulated oligonucleotides in their internal compartments from metabolism and degradation (Rosoff, in "Pharmaceutical Dosage Forms," Lieberman, Rieger and Banker (Eds.), 1988, volume 1, p. 245). Important considerations in the preparation of liposome formulations are the lipid surface charge, vesicle size and the aqueous volume of the liposomes.

A positively charged synthetic cationic lipid, N-[1-(2,3-dioleyloxy)propyl]-N,N,N-trimethylammonium chloride (DOTMA) can be used to form small liposomes that interact spontaneously with nucleic acid to form lipid-nucleic acid complexes which are capable of fusing with the negatively charged lipids of the cell membranes of tissue culture cells, resulting in delivery of oligonucleotide (see, e.g., Feigner, P. L et al., (1987) Proc Natl. Acad. Sci. USA 8:7413-7417, and U.S. Pat. No. 4,897,355 for a description of DOTMA and its use with DNA).

A DOTMA analogue, 1,2-bis(oleoyloxy)-3-(trimethylammonia)propane (DOTAP) can be used in combination with a phospholipid to form DNA-complexing vesicles. LIPOFECTIN$^{T}$M Bethesda Research Laboratories, Gaithersburg, Md.) is an effective agent for the delivery of highly anionic nucleic acids into living tissue culture cells that comprise positively charged DOTMA liposomes which interact spontaneously with negatively charged polynucleotides to form complexes. When enough positively charged liposomes are used, the net charge on the resulting complexes is also positive. Positively charged complexes prepared in this way spontaneously attach to negatively charged cell surfaces, fuse with the plasma membrane, and efficiently deliver functional nucleic acids into, for example, tissue culture cells. Another commercially available cationic lipid, 1,2-bis (oleoyloxy)-3,3-(trimethylammonia)propane ("DOTAP") (Boehnnger Mannheim, Indianapolis, Ind.) differs from DOTMA in that the oleoyl moieties are linked by ester, rather than ether linkages.

Other reported cationic lipid compounds include those that have been conjugated to a variety of moieties including, for example, carboxyspermine which has been conjugated to one of two types of lipids and includes compounds such as 5-carboxyspermylglycine dioctaoleoylamide ("DOGS") (TRANSFECTAM™, Promega, Madison, Wis.) and dipalmitoylphosphatidylethanolamine 5-carboxyspermyl-amide ("DPPES") (see, e.g., U.S. Pat. No. 5,171,678).

Another cationic lipid conjugate includes derivatization of the lipid with cholesterol ("DC-Chor") which has been formulated into liposomes in combination with DOPE (See, Gao, X. and Huang, L, (1991) Biochim. Biophys. Res. Commun. 179.280). Lipopolylysine, made by conjugating polylysine to DOPE, has been reported to be effective for transfection in the presence of serum (Zhou, X et al., (1991) Biochim Biophys Acta 1065-8). For certain cell lines, these liposomes containing conjugated cationic lipids, are said to exhibit lower toxicity and provide more efficient transfection than the DOTMA-containing compositions. Other commercially available cationic lipid products include DMRIE and DMRIE-HP (Vical, La Jolla, Calif.) and Lipofectamine® (DOSPA) (Life Technology, Inc., Gaithersburg, Md.). Other cationic lipids suitable for the delivery of oligonucleotides are described in WO 98/39359 and WO 96/37194.

Liposomal formulations are particularly suited for topical administration, liposomes present several advantages over other formulations. Such advantages include reduced side effects related to high systemic absorption of the administered drug, increased accumulation of the administered drug at the desired target, and the ability to administer oligonucleotide into the skin. In some implementations, liposomes are used for delivering oligonucleotide to epidermal cells and also to enhance the penetration of oligonucleotide into dermal tissues, e.g., into skin. For example, the liposomes can be applied topically. Topical delivery of drugs formulated as liposomes to the skin has been documented (see, e.g., Weiner et al., (1992) Journal of Drug Targeting, vol. 2,405-410 and du Plessis et al., (1992) Antiviral Research, 18:259-265; Mannino, R. J. and Fould-Fogerite, S., (1998) Biotechniques 6:682-690; Itani, T. et al., (1987) Gene 56:267-276; Nicolau, C. et al. (1987) Meth. Enzymol. 149:157-176; Straubinger, R. M. and Papahadjopoulos, D. (1983) Meth. Enzymol. 101:512-527; Wang, C. Y. and Huang, L., (1987) Proc. Natl. Acad. Sci USA 84:7851-7855).

Non-ionic liposomal systems have also been examined to determine their utility in the delivery of drugs to the skin, in particular systems comprising non-ionic surfactant and cholesterol. Non-ionic liposomal formulations comprising NOVASOME I (glyceryl dilaurate/cholesterol/polyoxyethylene-10-stearyl ether) and NOVASOME II (glyceryl distearate/cholesterol/polyoxyethylene-10-stearyl ether) were used to deliver a drug into the dermis of mouse skin. Such formulations with oligonucleotides are useful for treating a dermatological disorder.

The targeting of liposomes is also possible based on, for example, organ-specificity, cell-specificity, and organelle-specificity and is known in the art. In the case of a liposomal targeted delivery system, lipid groups can be incorporated into the lipid bilayer of the liposome to maintain the targeting ligand in stable association with the liposomal bilayer Various linking groups can be used for joining the lipid chains to the targeting ligand. Additional methods are known in the art and are described, for example in U.S. Patent Application Publication No. 20060058255, the linking groups of which are herein incorporated by reference.

Liposomes that include oligonucleotides can be made highly deformable Such deformability can enable the liposomes to penetrate through pore that are smaller than the average radius of the liposome. For example, transfersomes are yet another type of liposomes, and are highly deformable lipid aggregates which are attractive candidates for drug delivery vehicles. Transfersomes can be described as lipid droplets which are so highly deformable that they are easily able to penetrate through pores which are smaller than the droplet. Transfersomes can be made by adding surface edge activators, usually surfactants, to a standard liposomal composition. Transfersomes that include oligonucleotides can be delivered, for example, subcutaneously by infection to deliver oligonucleotides to keratinocytes in the skin. To cross intact mammalian skin, lipid vesicles must pass through a series of fine pores, each with a diameter less than 50 nm, under the influence of a suitable transdermal gradient. In addition, due to the lipid properties, these transfersomes can be self-optimizing (adaptive to the shape of pores, e.g., in the skin), self-repairing, and can frequently reach their targets without fragmenting, and often self-loading. Transfersomes have been used to deliver serum albumin to the skin. The transfersome-mediated delivery of serum albumin has been shown to be as effective as subcutaneous injection of a solution containing serum albumin.

Other suitable formulations are described in U.S. provisional application Ser. No. 61/018,616, filed Jan. 2, 2008; 61/018,611, filed Jan. 2, 2008; 61/039,748, filed Mar. 26, 2008; 61/047,087, filed Apr. 22, 2008 and 61/051,528, filed May 8, 2008. PCT application No. PCT/US2007/080331, filed Oct. 3, 2007 also describes suitable formulations.

Surfactants find wide application in formulations such as emulsions (including microemulsions) and liposomes. The most common way of classifying and ranking the properties of the many different types of surfactants, both natural and synthetic, is by the use of the hydrophile/lipophile balance (HLB). The nature of the hydrophilic group (also known as the "head") provides the most useful means for categonzing the different surfactants used in formulations (Rieger, in Pharmaceutical Dosage Forms, Marcel Dekker, Inc., New York, N.Y., 1988, p. 285).

If the surfactant molecule is not ionized, it is classified as a nonionic surfactant. Nonionic surfactants find wide application in pharmaceutical and cosmetic products and are usable over a wide range of pH values. In general, their HLB values range from 2 to about 18 depending on their structure. Nonionic surfactants include nonionic esters such as ethylene glycol esters, propylene glycol esters, glyceryl esters, polyglyceryl esters, sorbitan esters, sucrose esters, and ethoxylated esters. Nonionic alkanolamides and ethers such as fatty alcohol ethoxylates, propoxylated alcohols, and ethoxylated/propoxylated block polymers are also included in this class. The polyoxyethylene surfactants are the most popular members of the nonionic surfactant class If the surfactant molecule carries a negative charge when it is dissolved or dispersed in water, the surfactant is classified as anionic. Anionic surfactants include carboxylates such as soaps, acyl lactylates, acyl amides of amino acids, esters of sulfuric acid such as alkyl sulfates and ethoxylated alkyl sulfates, sulfonates such as alkyl benzene sulfonates, acyl isethionates, acyl taurates and sulfosuccinates, and phosphates. The most important members of the anionic surfactant class are the alkyl sulfates and the soaps.

If the surfactant molecule carries a positive charge when it is dissolved or dispersed in water, the surfactant is classified as cationic. Cationic surfactants include quaternary ammonium salts and ethoxylated amines. The quaternary ammonium salts are the most used members of this class.

If the surfactant molecule has the ability to carry either a positive or negative charge, the surfactant is classified as amphoteric. Amphoteric surfactants include acrylic acid derivatives, substituted alkylamides, N-alkylbetaines, and phosphatides.

The use of surfactants in drug products, formulations and in emulsions has been reviewed (Rieger, in Pharmaceutical Dosage Forms, Marcel Dekker, Inc., New York, N.Y., 1988, p. 285).

The oligonucleotides for use in the methods can be provided as micellar formulations. Micelles are a particular type of molecular assembly in which amphipathic molecules are arranged in a spherical structure such that all the hydrophobic portions of the molecules are directed inward, leaving the hydrophilic portions in contact with the surrounding aqueous phase. The converse arrangement exists if the environment is hydrophobic ii. Lipid Nanoparticle-Based Delivery Methods Oligonucleotides can be fully encapsulated in a lipid formulation, e.g., a lipid nanoparticle (LNP), or other nucleic acid-lipid particle. LNPs are extremely useful for systemic applications, as they exhibit extended circulation lifetimes following intravenous (i.v.) injection and accumulate at distal sites (e.g., sites physically separated from the administration site). LNPs include "pSPLP," which include an encapsulated condensing agent-nucleic acid complex as set forth in PCT Publication No WO 00/03683. The particles typically have a mean diameter of about 50 nm to about 150 nm, more typically about 60 nm to about 130 nm, more typically about 70 nm to about 110 nm, most typically about 70 nm to about 90 nm, and are substantially nontoxic. In addition, the nucleic acids when present in the nucleic acid-lipid particles are resistant in aqueous solution to degradation with a nuclease. Nucleic acid-lipid particles and their method of preparation are disclosed in, e.g., U.S. Pat. Nos. 5,976,567; 5,981,501; 6,534,484; 6,586,410; 6,815,432; U.S. Publication No. 2010/0324120 and PCT Publication No. WO 96/40964.

In one aspect, the lipid to drug ratio (mass/mass ratio) (e.g., lipid to oligonucleotide ratio) will be in the range of from about 1:1 to about 50:1, from about 1:1 to about 25:1, from about 3:1 to about 15:1, from about 4:1 to about 10:1, from about 5:1 to about 9:1, or about 6:1 to about 9:1. Ranges intermediate to the above recited ranges are also contemplated.

Non-limiting examples of cationic lipids include N,N-dioleyl-N,N-dimethylammonium chloride (DODAC), N,N-distearyl-N,N-dimethylammonium bromide (DDAB), N—(I-(2,3-dioleoyloxy)propyl)-N,N,N-trimethylammonium chloride (DOTAP), N—(I-(2,3-dioleyloxy)propyl)-N,N,N-trimethylammonium chloride (DOTMA), N,N-dimethyl-2,3-dioleyloxy)propylamine (DODMA), 1,2-DiLinoleyloxy-N,N-dimethylaminopropane (DLinDMA), 1,2-Dilinolenyloxy-N,N-dimethylaminopropane (DLenDMA), 1,2-Dilinoleylcarbamoyloxy-3-dimethylaminopropane (DLin-C-DAP), 1,2-Dilinoleyoxy-3-(dimethylamino)acetoxypropane (DLin-DAC), 1,2-Dilinoleyoxy-3-morpholinopropane (DLin-MA), 1,2-Dilinoleoyl-3-dimethylaminopropane (DLinDAP), 1,2-Dilinoleylthio-3-dimethylaminopropane (DLin-S-DMA), 1-Linoleoyl-2-linoleyloxy-3-dimethylaminopropane (DLin-2-DMAP), 1,2-Dilinoleyloxy-3-trimethylaminopropane chloride salt (DLin-TMA.CI), 1,2-Dilinoleoyl-3-trimethylaminopropane chloride salt (DLin-TAP.CI), 1,2-Dilinoleyloxy-3-(N-methylpiperazino)propane (DLin-MPZ), or 3-(N,N-Dilinoleylamino)-1,2-propanediol (DLinAP), 3-(N,N-Dioleylamino)-1,2-propanedio (DOAP), 1,2-Dilinoleyloxo-3-(2-N,N-dimethylamino)ethoxypropane (DLin-EG-DMA), 1,2-Dilinolenyloxy-N,N-dimethylaminopropane (DLinDMA), 2,2-Dilinoleyl-4-dimethylaminomethyl-[1,3]-dioxolane (DLin-K-DMA) or analogs thereof, (3aR,5s,6aS)—N,N-dimethyl-2,2-di((9Z,12Z)-octadeca-9,12-dienyetetrahydro-3aH-cyclopenta[d][1,3]dioxol-5-amine (ALN100), (6Z,9Z,28Z,31Z)-heptatriaconta-6,9,28,31-tetraen-19-yl4-(dimethylamino)butanoate (MC3), 1,1'-(2-(4-(2-((2-(bis(2-hydroxydodecyl)amino)ethyl)(2-hydroxydodecyl)amino) ethyl)piperazin-1-yeethylazanediyedidodecan-2-ol (Tech G1), or a mixture thereof. The cationic lipid can comprise, for example, from about 20 mol % to about 50 mol % or about 40 mol % of the total lipid present in the particle.

The ionizable/non-cationic lipid can be an anionic lipid or a neutral lipid including, but not limited to, distearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), dioleoyl-phosphatidylethanolamine (DOPE), palmitoyloleoylphosphatidylcholine (POPC), palmitoyloleoylphosphatidylethanolamine (POPE), dioleoyl-phosphatidylethanolamine 4-(N-maleimidomethyl)-cyclohexane-1-carboxylate (DOPE-mal), dipalmitoyl phosphatidyl ethanolamine (DPPE), dimyristoylphosphoethanolamine (DMPE), distearoyl-phosphatidyl-ethanolamine (DSPE), 16-O-monomethyl PE, 16-O-dimethyl PE, 18-1-trans PE, 1-stearoyl-2-oleoyl-phosphatidyethanolamine (SOPE), cholesterol, or a mixture thereof. The non-cationic lipid can be, for example, from about 5 mol % to about 90 mol %, about 10 mol %, or about 60 mol % if cholesterol is included, of the total lipid present in the particle.

The conjugated lipid that inhibits aggregation of particles can be, for example, a polyethyleneglycol (PEG)-lipid including, without limitation, a PEG-diacylglycerol (DAG), a PEG-dialkyloxypropyl (DAA), a PEG-phospholipid, a PEG-ceramide ($C_{16}$), or a mixture thereof. The PEG-DAA conjugate can be, for example, a PEG-dilaurylaxypropyl ($C_{12}$), a PEG-dimyristylaxypropyl ($C_{14}$), a PEG-dpalmityloxypropyl ($C_{16}$), or a PEG-distearyloxypropyl ($C_{18}$). The conjugated lipid that prevents aggregation of particles can be, for example, from 0 mol % to about 20 mol % or about 2 mol % of the total lipid present in the particle.

In some aspects, the nucleic acid-lipid particle further includes cholesterol at, e.g., about 10 mol % to about 60 mol % or about 50 mol % of the total lipid present in the particle B. Combination Therapies An oligonucleotide can be used alone or in combination with at least one additional therapeutic agent, e.g., other agents that treat trinucleotide repeat expansion disorders or symptoms associated therewith, or in combination with other types of therapies to treat trinucleotide repeat expansion disorders. In combination treatments, the dosages of one or more of the therapeutic compounds can be reduced from standard dosages when administered alone. For example, doses can be determined empirically from drug combinations and permutations or can be deduced by isobolographic analysis (e.g., Black et al., Neurology 65:S3-S6 (2005)) In this case, dosages of the compounds when combined should provide a therapeutic effect.

In some aspects, the oligonucleotide agents described herein can be used in combination with at least one additional therapeutic agent to treat a trinucleotide repeat expansion disorder associated with gene having a trinucleotide repeat (e.g., any of the trinucleotide repeat expansion disorders and associated genes having a trinucleotide repeat listed in Table 1). In some aspects, at least one of the additional therapeutic agents can be an oligonucleotide (e.g., an ASO) that hybridizes with the mRNA of gene associated with a trinucleotide repeat expansion disorder (e.g., any of the genes listed in Table 1). In some aspects, the trinucleotide repeat expansion disorder is Huntington's disease (HD) In some aspects, the gene associated with a trinucleotide repeat expansion disorder is Huntingtin (HTT). Several allelic variants of the Huntingtin gene have been implicated in the etiology of Huntington's disease. In some cases, these variants are identified on the basis of having unique HD-associated single nucleotide polymorphisms (SNPs). In some aspects, the oligonucleotide hybridizes to an mRNA of the Huntingtin gene containing any of the HD-associated SNPs known in the art (e.g., any of the HD-associated SNPs described in Skotte et al., PLoS One 2014, 9(9): e107434, Carroll et al., Mol. Ther. 2011, 19(12): 2178-85, Warby et al., Am. J. Hum. Gen. 2009, 84(3). 351-66 (herein incorporated by reference)). In some aspects, the oligonucleotide that is an additional therapeutic agent hybridizes to an mRNA of the Huntingtin gene lacking any of the HD-associated SNPs. In some of the aspects, the oligonucleotide hybridizes to an mRNA of the Huntingtin gene having any of the SNPs selected from the group of rs362307 and rs365331. In some aspects, the oligonucleotide that is an additional therapeutic agent can be a modified oligonucleotide (e.g., an oligonucleotide including any of the modifications described herein). In some aspects, the modified oligonucleotide that is an additional therapeutic agent comprises one or more phosphorothioate internucleoside linkages. In some aspects, the modified oligonucleotide that is an additional therapeutic agent comprises one or more 2'-MOE moieties. In some aspects, the oligonucleotide that is an additional therapeutic agent hybridizes to the mRNA of the Huntingtin gene has a sequence selected from the SEQ ID NOs. 6-285 of U.S. Pat. No. 9,006,198; SEQ ID NOs. 6-8 of US Patent Application Publication No. 2017/0044539; SEQ ID NOs. 1-1565 of US Patent Application Publication 2018/0216108; and SEQ ID NOs 1-2432 of PCT Publication WO 2017/192679, the sequences of which are hereby incorporated by reference.

In some aspects, at least one of the additional therapeutic agent is a chemotherapeutic agent (e.g., a cytotoxic agent or other chemical compound useful in the treatment of a trinucleotide repeat expansion disorder).

In some aspects, at least one of the additional therapeutic agents can be a therapeutic agent which is a non-drug treatment. For example, at least one of the additional therapeutic agents is physical therapy.

In any of the combination aspects described herein, the two or more therapeutic agents can be administered simultaneously or sequentially, in either order. For example a first therapeutic agent can be administered immediately, up to 1 hour, up to 2 hours, up to 3 hours, up to 4 hours, up to 5 hours, up to 6 hours, up to 7 hours, up to, 8 hours, up to 9 hours, up to 10 hours, up to 11 hours, up to 12 hours, up to 13 hours, 14 hours, up to hours 16, up to 17 hours, up 18 hours, up to 19 hours up to hours, up to 21 hours, up to 22 hours, up to 23 hours up to 24 hours or up to 1-7, 1-14, 1-21 or 1-30 days before or after one or more of the additional therapeutic agents.

V. Pharmaceutical Compositions

The oligonucleotides described herein can be formulated into pharmaceutical compositions for administration to human subjects in a biologically compatible form suitable for administration in vivo.

The compounds described herein can be used in the form of the free base, in the form of salts, solvates, and as prodrugs. All forms are within the methods described herein. In accordance with the methods described herein, the described oligonucleotides or salts, solvates, or prodrugs thereof can be administered to a patient in a variety of forms depending on the selected route of administration, as will be understood by those skilled in the art. The compounds described herein can be administered, for example, by oral, parenteral, intrathecal, intracerebroventricular, intraparenchymal, buccal, sublingual, nasal, rectal, patch, pump, ortransdermal administration and the pharmaceutical compositions formulated accordingly. Parenteral administration includes intravenous, intraperitoneal, subcutaneous, intramuscular, transepithelial, nasal, intrapulmonary, intrathecal, intracerebroventricular, intraparenchymal, rectal, and topical modes of administration. Parenteral administration can be by continuous infusion over a selected period of time.

A compound described herein can be orally administered, for example, with an inert diluent or with an assimilable edible carrier, or it can be enclosed in hard or soft shell gelatin capsules, or it can be compressed into tablets, or it can be incorporated directly with the food of the diet. For oral therapeutic administration, a compound described herein can be incorporated with an excipient and used in the form of ingestible tablets, buccal tablets, troches, capsules, elixirs, suspensions, syrups, and wafers. A compound described herein can be administered parenterally. Solutions of a compound described herein can be prepared in water suitably mixed with a surfactant, such as hydroxypropylcellulose. Dispersions can be prepared in glycerol, liquid polyethylene glycols, DMSO, and mixtures thereof with or without alcohol, and in oils. Under ordinary conditions of storage and use, these preparations can contain a preservative to prevent the growth of microorganisms. Conventional procedures and ingredients for the selection and preparation of suitable formulations are described, for example, in Remington's Pharmaceutical Sciences (2012, 22nd ed.) and in. The United States Pharmacopeia: The National Formulary (USP 41 NF 36), published in 2018. The pharmaceutical forms suitable for injectable use include sterile aqueous solutions or dispersions and sterile powders for the extemporaneous preparation of sterile injectable solutions or dispersions. In all cases the form must be sterile and must be fluid to the extent that can be easily administered via syringe. Compositions for nasal administration can conveniently be formulated as aerosols, drops, gels, and powders. Aerosol formulations typically include a solution or fine suspension of the active substance in a physiologically acceptable aqueous or non-aqueous solvent and are usually presented in single or multidose quantities in sterile form in a sealed container, which can take the form of a cartridge or refill for use with an atomizing device. Alternatively, the sealed container can be a unitary dispensing device, such as a single dose nasal inhaler or an aerosol dispenser fitted with a metering valve which is intended for disposal after use. Where the dosage form includes an aerosol dispenser, it will contain a propellant, which can be a compressed gas, such as compressed air or an organic propellant, such as fluorochlorohydrocarbon. The aerosol dosage forms can take the form of a pump-atomizer Compositions suitable for buccal or sublingual administration include tablets, lozenges, and pastilles, where the active ingredient is formulated with a carrier, such as sugar, acacia, tragacanth, gelatin, and glycerine. Compositions for rectal administration are conveniently in the form of suppositories containing a conventional suppository base, such as cocoa butter The compounds described herein can be administered to an animal, e.g., a human, alone or in combination with pharmaceutically acceptable carriers, as noted herein, the proportion of which is determined by the solubility and chemical nature of the compound, chosen route of administration, and standard pharmaceutical practice.

VI. Dosages

The dosage of the compositions (e.g., a composition including an oligonucleotide) described herein, can vary depending on many factors, such as the pharmacodynamic properties of the compound; the mode of administration; the age, health, and weight of the recipient; the nature and extent of the symptoms; the frequency of the treatment, and the type of concurrent treatment, if any; and the clearance rate of the compound in the animal to be treated. The compositions described herein can be administered initially in a suitable dosage that can be adjusted as required, depending on the clinical response. In some aspects, the dosage of a composition (e.g., a composition including an oligonucleotide) is a prophylactically or a therapeutically effective amount VII. Kits Kits including (a) a pharmaceutical composition including an oligonucleotide agent that reduces the level and/or activity of MLH3 in a cell or subject described herein, and (b) a package insert with instructions to perform any of the methods described herein are contemplated. In some aspects, the kit includes (a) a pharmaceutical composition including an oligonucleotide agent that reduces the level and/or activity of MLH3 in a cell or subject described herein, (b) an additional therapeutic agent, and (c) a package insert with instructions to perform any of the methods described herein.

EXAMPLES

Example 1. Design and Selection of Antisense Oligonucleotides

Identification and selection of target transcripts: Target transcript selection and off-target scoring (below) utilized NCBI RefSeq sequences, downloaded from NCBI 21 Nov. 2018. Experimentally validated "NM" transcript models were used except for cynomolgus monkey, which only has "XM" predicted models for the large majority of genes. The longest human, mouse, rat, and cynomolgus monkey MLH3 transcript that contained all mapped internal exons was selected (SEQ IDs 1, 3, 4, and 5 for human, mouse, rat, and cynomolgus monkey, respectively, SEQ ID NO:2 is the protein sequence).

Selection of 20mer oligonucleotide sequences: All antisense 20mer sub-sequences per transcript were generated Candidate antisense oligonucleotides ('ASOs') were selected that met the following thermodynamic and physical characteristics determined by the inventors: predicted melting temperature of ASO:target duplex ("$T_m$") of 30-65° C., predicted melting temperature of hairpins ("$T_{hairpin}$")<35° C., predicted melting temperature of homopolymer formation ("$T_{homo}$")<25° C., GC content of 20-60%, no G homopolymers 4 or longer, and no A, T, or C homopolymers of 6 or longer. These selected or 'preferred' oligonucleotides were further evaluated for specificity (off-target scoring, below).

Off-target scoring: The specificity of the preferred ASOs was evaluated via alignment to all unspliced RefSeq transcripts ("NM" models for human, mouse, and rat; "NM' and'XM" models for cynomolgus monkey), using the FASTA algorithm with an E value cutoff of 1000. The number of mismatches between each ASO and each transcript (per species) was tallied. An "off-target score" for each ASO in each species was calculated as the lowest number of mismatches to any transcript other than those encoded by the MLH3 gene Selection of ASOs for screening: A set of 480 preferred ASOs was selected for screening according to both specificity and ASO:mRNA (target) hybridization energy maximization information as follows. All candidate ASOs were evaluated for delta G of hybridization with the predicted target mRNA secondary structure ($\Delta G_{overall}$) according to Xu and Mathews (*Methods Mol Biol.* 1490:15-34 (2016)). Next, two subsets of ASOs were chosen: First, 40 ASOs that matched human, cyno, and mouse target transcripts, had off-target scores of at least 1 in three species, and negative $\Delta G^{overall}$; second, 440 ASOs that matched human and cyno target transcripts, had off-target scores of at least 2 in both species, and $\Delta G^{overall}$ less than −9.5 degrees Celsius.

The sequences, positions in human transcript, conservation in other species and species-specific off-target scores of each ASO are given in Table 2. Wherever indicated as "NC", the ASO does not match the MLH3 gene in that species, and therefore off-target scores were not generated.

ASOs were synthesized as 5-10-5 "flanking sequence-DNA core sequence-flanking sequence" antisense oligonucleotides, with riboniucleotides at positions 1-5 and 16-20 and deoxyribonucleotides at positions 6-15. and with the following generic structure:

5-NmsNmsNmsNmsNms NsNsNsNsNs NsNsNsNsNs NmsNmsNmsNmsNm-3'

Wherein:

Nm: 2'-MOE residues (including 5methyl-2'-MOE-C and 5methyl-2'-MOE-U)

N: DNA/RNA residues s: phosphorothioate (the backbone is fully phosphorothioate-modified)

All "C" within the DNA core (positions 6-15) are 5-Methyl-2'-MOE-dC

All "T" in positions 1-5 or 16-20 are 5-methyl-2'-MOE-U.

For primary screens at 2 nM and 20 nM, desalted oligonucleotides were used. For detailed characterization of a subset of oligonucleotides, oligonucleotides were further purified by HPLC.

TABLE 2

Exemplary Oligonucleotides

| SEQ ID NO | Position | Sequence | Off-target Score Human | Cyno | Mouse | Rat |
|---|---|---|---|---|---|---|
| 6 | 75 | CTTGGATCTTGAGGCTCGTG | 3 | NC | NC | NC |
| 7 | 76 | CCTTGGATCTTGAGGCTCGT | 2 | NC | NC | NC |
| 8 | 77 | ACCTTGGATCTTGAGGCTCG | 3 | NC | NC | NC |
| 9 | 78 | CACCTTGGATCTTGAGGCTC | 2 | NC | NC | NC |
| 10 | 79 | GCACCTTGGATCTTGAGGCT | 2 | NC | NC | NC |
| 11 | 116 | AATTCTCCGACACCAACCGC | 3 | NC | NC | NC |
| 12 | 117 | AAATTCTCCGACACCAACCG | 3 | NC | NC | NC |
| 13 | 118 | CAAATTCTCCGACACCAACC | 2 | NC | NC | NC |
| 14 | 119 | ACAAATTCTCCGACACCAAC | 2 | NC | NC | NC |
| 15 | 120 | AACAAATTCTCCGACACCAA | 2 | NC | NC | NC |
| 16 | 121 | TAACAAATTCTCCGACACCA | 2 | NC | NC | NC |
| 17 | 122 | TTAACAAATTCTCCGACACC | 2 | NC | NC | NC |
| 18 | 123 | CTTAACAAATTCTCCGACAC | 3 | NC | NC | NC |
| 19 | 124 | GCTTAACAAATTCTCCGACA | 2 | NC | NC | NC |
| 20 | 125 | CGCTTAACAAATTCTCCGAC | 3 | NC | NC | NC |
| 21 | 126 | CCGCTTAACAAATTCTCCGA | 3 | NC | NC | NC |
| 22 | 127 | CCCGCTTAACAAATTCTCCG | 2 | NC | NC | NC |
| 23 | 128 | TCCCGCTTAACAAATTCTCC | 2 | NC | NC | NC |
| 24 | 129 | GTCCCGCTTAACAAATTCTC | 2 | NC | NC | NC |
| 25 | 130 | AGTCCCGCTTAACAAATTCT | 3 | NC | NC | NC |
| 26 | 131 | GAGTCCCGCTTAACAAATTC | 2 | NC | NC | NC |
| 27 | 132 | GGAGTCCCGCTTAACAAATT | 2 | NC | NC | NC |
| 28 | 133 | TGGAGTCCCGCTTAACAAAT | 3 | NC | NC | NC |
| 29 | 134 | CTGGAGTCCCGCTTAACAAA | 2 | NC | NC | NC |
| 30 | 135 | CCTGGAGTCCCGCTTAACAA | 3 | NC | NC | NC |
| 31 | 138 | TTGCCTGGAGTCCCGCTTAA | 3 | NC | NC | NC |
| 32 | 139 | ATTGCCTGGAGTCCCGCTTA | 3 | NC | NC | NC |
| 33 | 140 | AATTGCCTGGAGTCCCGCTT | 3 | NC | NC | NC |
| 34 | 141 | TAATTGCCTGGAGTCCCGCT | 3 | NC | NC | NC |
| 35 | 142 | ATAATTGCCTGGAGTCCCGC | 2 | NC | NC | NC |
| 36 | 143 | AATAATTGCCTGGAGTCCCG | 2 | NC | NC | NC |
| 37 | 144 | AAATAATTGCCTGGAGTCCC | 2 | NC | NC | NC |
| 38 | 145 | GAAATAATTGCCTGGAGTCC | 2 | NC | NC | NC |
| 39 | 146 | GGAAATAATTGCCTGGAGTC | 2 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 40 | 147 | TGGAAATAATTGCCTGGAGT | 1 | NC | NC | NC |
| 41 | 148 | CTGGAAATAATTGCCTGGAG | 2 | NC | NC | NC |
| 42 | 149 | ACTGGAAATAATTGCCTGGA | 2 | NC | NC | NC |
| 43 | 150 | GACTGGAAATAATTGCCTGG | 1 | NC | NC | NC |
| 44 | 151 | TGACTGGAAATAATTGCCTG | 2 | NC | NC | NC |
| 45 | 152 | CTGACTGGAAATAATTGCCT | 1 | NC | NC | NC |
| 46 | 153 | TCTGACTGGAAATAATTGCC | 2 | NC | NC | NC |
| 47 | 154 | CTCTGACTGGAAATAATTGC | 2 | NC | NC | NC |
| 48 | 155 | TCTCTGACTGGAAATAATTG | 2 | NC | NC | NC |
| 49 | 156 | TTCTCTGACTGGAAATAATT | 2 | NC | NC | NC |
| 50 | 157 | CTTCTCTGACTGGAAATAAT | 2 | NC | NC | NC |
| 51 | 158 | CCTTCTCTGACTGGAAATAA | 2 | NC | NC | NC |
| 52 | 159 | TCCTTCTCTGACTGGAAATA | 1 | NC | NC | NC |
| 53 | 160 | TTCCTTCTCTGACTGGAAAT | 1 | NC | NC | NC |
| 54 | 162 | GTTTCCTTCTCTGACTGGAA | 0 | NC | NC | NC |
| 55 | 163 | GGTTTCCTTCTCTGACTGGA | 1 | NC | NC | NC |
| 56 | 164 | TGGTTTCCTTCTCTGACTGG | 2 | NC | NC | NC |
| 57 | 165 | CTGGTTTCCTTCTCTGACTG | 2 | NC | NC | NC |
| 58 | 166 | ACTGGTTTCCTTCTCTGACT | 2 | NC | NC | NC |
| 59 | 167 | CACTGGTTTCCTTCTCTGAC | 2 | NC | NC | NC |
| 60 | 168 | GCACTGGTTTCCTTCTCTGA | 2 | NC | NC | NC |
| 61 | 169 | GGCACTGGTTTCCTTCTCTG | 1 | NC | NC | NC |
| 62 | 170 | AGGCACTGGTTTCCTTCTCT | 1 | NC | NC | NC |
| 63 | 186 | AGATGGTGAGAATGCCAGGC | 2 | NC | NC | NC |
| 64 | 187 | AAGATGGTGAGAATGCCAGG | 2 | NC | NC | NC |
| 65 | 188 | AAAGATGGTGAGAATGCCAG | 1 | NC | NC | NC |
| 66 | 190 | AGAAAGATGGTGAGAATGCC | 1 | 1 | NC | NC |
| 67 | 191 | TAGAAAGATGGTGAGAATGC | 2 | 1 | NC | NC |
| 68 | 192 | GTAGAAAGATGGTGAGAATG | 2 | 1 | NC | NC |
| 69 | 193 | GGTAGAAAGATGGTGAGAAT | 2 | 2 | NC | NC |
| 70 | 194 | AGGTAGAAAGATGGTGAGAA | 2 | 1 | NC | NC |
| 71 | 195 | TAGGTAGAAAGATGGTGAGA | 2 | 2 | NC | NC |
| 72 | 196 | GTAGGTAGAAAGATGGTGAG | 2 | 2 | NC | NC |
| 73 | 197 | GGTAGGTAGAAAGATGGTGA | 2 | 2 | NC | NC |
| 74 | 198 | TGGTAGGTAGAAAGATGGTG | 2 | 2 | NC | NC |
| 75 | 199 | ATGGTAGGTAGAAAGATGGT | 2 | 2 | NC | NC |
| 76 | 200 | CATGGTAGGTAGAAAGATGG | 2 | 2 | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 77 | 201 | TCATGGTAGGTAGAAAGATG | 2 | 2 | NC | NC |
| 78 | 202 | ATCATGGTAGGTAGAAAGAT | 1 | 2 | NC | NC |
| 79 | 203 | GATCATGGTAGGTAGAAAGA | 2 | 2 | NC | NC |
| 80 | 204 | TGATCATGGTAGGTAGAAAG | 2 | 2 | NC | NC |
| 81 | 205 | TTGATCATGGTAGGTAGAAA | 2 | 2 | NC | NC |
| 82 | 206 | CTTGATCATGGTAGGTAGAA | 2 | 2 | NC | NC |
| 83 | 207 | ACTTGATCATGGTAGGTAGA | 2 | 2 | NC | NC |
| 84 | 208 | CACTTGATCATGGTAGGTAG | 2 | 2 | NC | NC |
| 85 | 209 | GCACTTGATCATGGTAGGTA | 2 | 2 | NC | NC |
| 86 | 210 | AGCACTTGATCATGGTAGGT | 2 | 2 | NC | NC |
| 87 | 211 | AAGCACTTGATCATGGTAGG | 2 | 2 | NC | NC |
| 88 | 223 | ACTTCAACTGACAAGCACTT | 2 | 2 | NC | NC |
| 89 | 224 | TACTTCAACTGACAAGCACT | 2 | 2 | NC | NC |
| 90 | 225 | GTACTTCAACTGACAAGCAC | 2 | 2 | NC | NC |
| 91 | 226 | TGTACTTCAACTGACAAGCA | 1 | 2 | NC | NC |
| 92 | 227 | TTGTACTTCAACTGACAAGC | 2 | 2 | NC | NC |
| 93 | 229 | GCTTGTACTTCAACTGACAA | 2 | 2 | NC | NC |
| 94 | 230 | GGCTTGTACTTCAACTGACA | 2 | 2 | NC | NC |
| 95 | 231 | TGGCTTGTACTTCAACTGAC | 2 | 2 | NC | NC |
| 96 | 232 | TTGGCTTGTACTTCAACTGA | 2 | 2 | NC | NC |
| 97 | 233 | TTTGGCTTGTACTTCAACTG | 2 | 2 | NC | NC |
| 98 | 234 | ATTTGGCTTGTACTTCAACT | 2 | 2 | NC | NC |
| 99 | 235 | AATTTGGCTTGTACTTCAAC | 2 | 2 | NC | NC |
| 100 | 236 | CAATTTGGCTTGTACTTCAA | 2 | 2 | NC | NC |
| 101 | 237 | GCAATTTGGCTTGTACTTCA | 2 | 2 | NC | NC |
| 102 | 238 | CGCAATTTGGCTTGTACTTC | 2 | 3 | NC | NC |
| 103 | 239 | ACGCAATTTGGCTTGTACTT | 2 | 3 | NC | NC |
| 104 | 240 | AACGCAATTTGGCTTGTACT | 2 | 3 | NC | NC |
| 105 | 241 | GAACGCAATTTGGCTTGTAC | 2 | 2 | NC | NC |
| 106 | 242 | AGAACGCAATTTGGCTTGTA | 2 | 2 | NC | NC |
| 107 | 243 | CAGAACGCAATTTGGCTTGT | 3 | 2 | NC | NC |
| 108 | 244 | CCAGAACGCAATTTGGCTTG | 3 | 3 | NC | NC |
| 109 | 245 | ACCAGAACGCAATTTGGCTT | 3 | 2 | NC | NC |
| 110 | 246 | AACCAGAACGCAATTTGGCT | 2 | 2 | NC | NC |
| 111 | 247 | AAACCAGAACGCAATTTGGC | 2 | 2 | NC | NC |
| 112 | 249 | CCAAACCAGAACGCAATTTG | 2 | 3 | NC | NC |
| 113 | 250 | GCCAAACCAGAACGCAATTT | 2 | 2 | NC | NC |

TABLE 2-continued

| Exemplary Oligonucleotides | | | | | | |
|---|---|---|---|---|---|---|
| SEQ | | | Off-target Score | | | |
| ID NO | Position | Sequence | Human | Cyno | Mouse | Rat |
| 114 | 269 | TTGGCCCAAGGAGCTTATGG | 1 | 2 | NC | NC |
| 115 | 270 | ATTGGCCCAAGGAGCTTATG | 2 | 2 | NC | NC |
| 116 | 271 | CATTGGCCCAAGGAGCTTAT | 2 | 3 | NC | NC |
| 117 | 272 | ACATTGGCCCAAGGAGCTTA | 2 | 3 | NC | NC |
| 118 | 273 | CACATTGGCCCAAGGAGCTT | 2 | 3 | NC | NC |
| 119 | 274 | ACACATTGGCCCAAGGAGCT | 1 | 2 | NC | NC |
| 120 | 275 | AACACATTGGCCCAAGGAGC | 2 | 2 | NC | NC |
| 121 | 276 | CAACACATTGGCCCAAGGAG | 2 | 2 | NC | NC |
| 122 | 277 | TCAACACATTGGCCCAAGGA | 2 | 2 | NC | NC |
| 123 | 278 | CTCAACACATTGGCCCAAGG | 2 | 2 | NC | NC |
| 124 | 279 | CCTCAACACATTGGCCCAAG | 2 | 2 | NC | NC |
| 125 | 280 | TCCTCAACACATTGGCCCAA | 1 | 1 | NC | NC |
| 126 | 281 | TTCCTCAACACATTGGCCCA | 1 | 1 | NC | NC |
| 127 | 282 | GTTCCTCAACACATTGGCCC | 2 | 2 | NC | NC |
| 128 | 283 | AGTTCCTCAACACATTGGCC | 2 | 1 | NC | NC |
| 129 | 284 | AAGTTCCTCAACACATTGGC | 2 | 2 | NC | NC |
| 130 | 285 | CAAGTTCCTCAACACATTGG | 2 | 2 | NC | NC |
| 131 | 286 | GCAAGTTCCTCAACACATTG | 2 | 2 | NC | NC |
| 132 | 287 | GGCAAGTTCCTCAACACATT | 2 | 2 | NC | NC |
| 133 | 288 | GGGCAAGTTCCTCAACACAT | 2 | 2 | NC | NC |
| 134 | 289 | AGGGCAAGTTCCTCAACACA | 2 | 2 | NC | NC |
| 135 | 296 | ACTGTTGAGGGCAAGTTCCT | 2 | 2 | NC | NC |
| 136 | 297 | TACTGTTGAGGGCAAGTTCC | 2 | 2 | NC | NC |
| 137 | 298 | ATACTGTTGAGGGCAAGTTC | 2 | 2 | NC | NC |
| 138 | 299 | AATACTGTTGAGGGCAAGTT | 2 | 1 | NC | NC |
| 139 | 300 | CAATACTGTTGAGGGCAAGT | 2 | 2 | NC | NC |
| 140 | 301 | TCAATACTGTTGAGGGCAAG | 2 | 2 | NC | NC |
| 141 | 302 | ATCAATACTGTTGAGGGCAA | 1 | 1 | NC | NC |
| 142 | 303 | CATCAATACTGTTGAGGGCA | 2 | 2 | NC | NC |
| 143 | 304 | GCATCAATACTGTTGAGGGC | 2 | 2 | NC | NC |
| 144 | 305 | AGCATCAATACTGTTGAGGG | 2 | 2 | NC | NC |
| 145 | 306 | CAGCATCAATACTGTTGAGG | 2 | 2 | NC | NC |
| 146 | 307 | TCAGCATCAATACTGTTGAG | 2 | 2 | NC | NC |
| 147 | 308 | TTCAGCATCAATACTGTTGA | 2 | 2 | NC | NC |
| 148 | 309 | CTTCAGCATCAATACTGTTG | 2 | 2 | NC | NC |
| 149 | 323 | AGCCACACATTTTGCTTCAG | 1 | 2 | NC | NC |
| 150 | 324 | CAGCCACACATTTTGCTTCA | 2 | 2 | NC | NC |

TABLE 2-continued

| Exemplary Oligonucleotides | | | | | | |
|---|---|---|---|---|---|---|
| SEQ | | | Off-target Score | | | |
| ID NO | Position | Sequence | Human | Cyno | Mouse | Rat |
| 151 | 325 | ACAGCCACACATTTTGCTTC | 2 | 2 | NC | NC |
| 152 | 326 | GACAGCCACACATTTTGCTT | 2 | 2 | NC | NC |
| 153 | 327 | TGACAGCCACACATTTTGCT | 1 | 2 | NC | NC |
| 154 | 328 | CTGACAGCCACACATTTTGC | 2 | 2 | NC | NC |
| 155 | 329 | CCTGACAGCCACACATTTTG | 1 | 1 | NC | NC |
| 156 | 330 | CCCTGACAGCCACACATTTT | 1 | 2 | NC | NC |
| 157 | 331 | ACCCTGACAGCCACACATTT | 1 | 1 | NC | NC |
| 158 | 332 | CACCCTGACAGCCACACATT | 1 | 1 | NC | NC |
| 159 | 333 | TCACCCTGACAGCCACACAT | 1 | 1 | NC | NC |
| 160 | 334 | TTCACCCTGACAGCCACACA | 2 | 1 | NC | NC |
| 161 | 335 | ATTCACCCTGACAGCCACAC | 2 | 2 | NC | NC |
| 162 | 336 | TATTCACCCTGACAGCCACA | 2 | 2 | NC | NC |
| 163 | 337 | ATATTCACCCTGACAGCCAC | 2 | 2 | NC | NC |
| 164 | 338 | CATATTCACCCTGACAGCCA | 2 | 2 | NC | NC |
| 165 | 339 | CCATATTCACCCTGACAGCC | 1 | 2 | NC | NC |
| 166 | 340 | TCCATATTCACCCTGACAGC | 2 | 2 | NC | NC |
| 167 | 341 | TTCCATATTCACCCTGACAG | 2 | 2 | NC | NC |
| 168 | 342 | TTTCCATATTCACCCTGACA | 2 | 2 | NC | NC |
| 169 | 343 | GTTTCCATATTCACCCTGAC | 2 | 2 | NC | NC |
| 170 | 344 | GGTTTCCATATTCACCCTGA | 2 | 2 | NC | NC |
| 171 | 345 | AGGTTTCCATATTCACCCTG | 2 | 2 | NC | NC |
| 172 | 346 | AAGGTTTCCATATTCACCCT | 2 | 2 | NC | NC |
| 173 | 347 | GAAGGTTTCCATATTCACCC | 2 | 2 | NC | NC |
| 174 | 358 | ACTTGAACTTGGAAGGTTTC | 2 | 2 | 2 | 2 |
| 175 | 359 | CACTTGAACTTGGAAGGTTT | 2 | 2 | 2 | 1 |
| 176 | 360 | TCACTTGAACTTGGAAGGTT | 1 | 1 | 1 | 2 |
| 177 | 361 | ATCACTTGAACTTGGAAGGT | 0 | 0 | 1 | 2 |
| 178 | 362 | TATCACTTGAACTTGGAAGG | 1 | 1 | 2 | 3 |
| 179 | 363 | CTATCACTTGAACTTGGAAG | 2 | 2 | 1 | 2 |
| 180 | 364 | TCTATCACTTGAACTTGGAA | 2 | 1 | 1 | 2 |
| 181 | 365 | GTCTATCACTTGAACTTGGA | 2 | 1 | 1 | 2 |
| 182 | 366 | TGTCTATCACTTGAACTTGG | 2 | 2 | 1 | 1 |
| 183 | 367 | TTGTCTATCACTTGAACTTG | 2 | 2 | 2 | 2 |
| 184 | 368 | ATTGTCTATCACTTGAACTT | 2 | 2 | 2 | NC |
| 185 | 369 | CATTGTCTATCACTTGAACT | 2 | 2 | 2 | NC |
| 186 | 370 | CCATTGTCTATCACTTGAAC | 2 | 2 | 2 | NC |
| 187 | 371 | TCCATTGTCTATCACTTGAA | 2 | 2 | 2 | NC |

TABLE 2-continued

| Exemplary Oligonucleotides | | | | | | |
|---|---|---|---|---|---|---|
| SEQ | | | Off-target Score | | | |
| ID NO | Position | Sequence | Human | Cyno | Mouse | Rat |
| 188 | 372 | ATCCATTGTCTATCACTTGA | 2 | 2 | NC | NC |
| 189 | 373 | AATCCATTGTCTATCACTTG | 2 | 2 | NC | NC |
| 190 | 374 | AAATCCATTGTCTATCACTT | 1 | 1 | NC | NC |
| 191 | 375 | CAAATCCATTGTCTATCACT | 2 | 2 | NC | NC |
| 192 | 376 | CCAAATCCATTGTCTATCAC | 2 | 2 | NC | NC |
| 193 | 377 | CCCAAATCCATTGTCTATCA | 2 | 2 | NC | NC |
| 194 | 378 | TCCCAAATCCATTGTCTATC | 2 | 2 | NC | NC |
| 195 | 379 | ATCCCAAATCCATTGTCTAT | 2 | 2 | NC | NC |
| 196 | 380 | CATCCCAAATCCATTGTCTA | 2 | 2 | NC | NC |
| 197 | 381 | CCATCCCAAATCCATTGTCT | 1 | 1 | NC | NC |
| 198 | 382 | CCCATCCCAAATCCATTGTC | 1 | 1 | NC | NC |
| 199 | 383 | CCCCATCCCAAATCCATTGT | 1 | 2 | NC | NC |
| 200 | 385 | CTCCCCATCCCAAATCCATT | 1 | 1 | NC | NC |
| 201 | 386 | ACTCCCCATCCCAAATCCAT | 2 | 2 | NC | NC |
| 202 | 387 | CACTCCCCATCCCAAATCCA | 1 | 2 | NC | NC |
| 203 | 388 | TCACTCCCCATCCCAAATCC | 1 | 2 | NC | NC |
| 204 | 389 | ATCACTCCCCATCCCAAATC | 1 | 1 | NC | NC |
| 205 | 390 | CATCACTCCCCATCCCAAAT | 2 | 2 | NC | NC |
| 206 | 391 | TCATCACTCCCCATCCCAAA | 2 | 2 | NC | NC |
| 207 | 392 | ATCATCACTCCCCATCCCAA | 2 | 2 | NC | NC |
| 208 | 393 | CATCATCACTCCCCATCCCA | 2 | 2 | NC | NC |
| 209 | 394 | ACATCATCACTCCCCATCCC | 1 | 2 | NC | NC |
| 210 | 395 | TACATCATCACTCCCCATCC | 1 | 2 | NC | NC |
| 211 | 396 | CTACATCATCACTCCCCATC | 2 | 2 | NC | NC |
| 212 | 397 | TCTACATCATCACTCCCCAT | 2 | 2 | NC | NC |
| 213 | 398 | CTCTACATCATCACTCCCCA | 2 | 1 | NC | NC |
| 214 | 399 | TCTCTACATCATCACTCCCC | 2 | 1 | NC | NC |
| 215 | 400 | TTCTCTACATCATCACTCCC | 2 | 1 | NC | NC |
| 216 | 401 | TTTCTCTACATCATCACTCC | 2 | 2 | NC | NC |
| 217 | 402 | CTTTCTCTACATCATCACTC | 2 | 2 | NC | NC |
| 218 | 403 | ACTTTCTCTACATCATCACT | 2 | 1 | NC | NC |
| 219 | 404 | CACTTTCTCTACATCATCAC | 1 | 1 | NC | NC |
| 220 | 405 | CCACTTTCTCTACATCATCA | 1 | 1 | NC | NC |
| 221 | 406 | CCCACTTTCTCTACATCATC | 1 | 2 | NC | NC |
| 222 | 407 | TCCCACTTTCTCTACATCAT | 1 | 2 | NC | NC |
| 223 | 408 | TTCCCACTTTCTCTACATCA | 2 | 2 | NC | NC |
| 224 | 409 | TTTCCCACTTTCTCTACATC | 2 | 2 | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 225 | 410 | ATTTCCCACTTTCTCTACAT | 1 | 1 | NC | NC |
| 226 | 411 | GATTTCCCACTTTCTCTACA | 1 | 2 | NC | NC |
| 227 | 412 | CGATTTCCCACTTTCTCTAC | 2 | 2 | NC | NC |
| 228 | 413 | ACGATTTCCCACTTTCTCTA | 2 | 2 | NC | NC |
| 229 | 414 | AACGATTTCCCACTTTCTCT | 2 | 2 | NC | NC |
| 230 | 415 | TAACGATTTCCCACTTTCTC | 2 | 2 | NC | NC |
| 231 | 416 | ATAACGATTTCCCACTTTCT | 2 | 2 | NC | NC |
| 232 | 417 | AATAACGATTTCCCACTTTC | 2 | 2 | NC | NC |
| 233 | 418 | AAATAACGATTTCCCACTTT | 2 | 2 | NC | NC |
| 234 | 426 | TACTGGTGAAATAACGATTT | 2 | 3 | NC | NC |
| 235 | 427 | TTACTGGTGAAATAACGATT | 2 | 2 | NC | NC |
| 236 | 428 | TTTACTGGTGAAATAACGAT | 2 | 2 | NC | NC |
| 237 | 429 | ATTTACTGGTGAAATAACGA | 2 | 2 | NC | NC |
| 238 | 430 | CATTTACTGGTGAAATAACG | 2 | 2 | NC | NC |
| 239 | 431 | GCATTTACTGGTGAAATAAC | 1 | 2 | NC | NC |
| 240 | 432 | GGCATTTACTGGTGAAATAA | 2 | 2 | NC | NC |
| 241 | 433 | TGGCATTTACTGGTGAAATA | 2 | 2 | NC | NC |
| 242 | 434 | GTGGCATTTACTGGTGAAAT | 2 | 1 | NC | NC |
| 243 | 435 | AGTGGCATTTACTGGTGAAA | 2 | 2 | NC | NC |
| 244 | 436 | GAGTGGCATTTACTGGTGAA | 2 | 2 | NC | NC |
| 245 | 437 | CGAGTGGCATTTACTGGTGA | 2 | 2 | NC | NC |
| 246 | 438 | CCGAGTGGCATTTACTGGTG | 3 | 3 | NC | NC |
| 247 | 451 | TCCAAGTCCTGTACCGAGTG | 2 | 2 | NC | NC |
| 248 | 452 | CTCCAAGTCCTGTACCGAGT | 3 | 3 | NC | NC |
| 249 | 453 | TCTCCAAGTCCTGTACCGAG | 3 | 3 | NC | NC |
| 250 | 454 | TTCTCCAAGTCCTGTACCGA | 2 | 3 | NC | NC |
| 251 | 455 | ATTCTCCAAGTCCTGTACCG | 2 | 3 | NC | NC |
| 252 | 456 | GATTCTCCAAGTCCTGTACC | 2 | 2 | NC | NC |
| 253 | 457 | GGATTCTCCAAGTCCTGTAC | 1 | 2 | NC | NC |
| 254 | 468 | CATAAAACCTTGGATTCTCC | 2 | 1 | NC | NC |
| 255 | 469 | CCATAAAACCTTGGATTCTC | 2 | 2 | NC | NC |
| 256 | 470 | ACCATAAAACCTTGGATTCT | 1 | 2 | NC | NC |
| 257 | 471 | AACCATAAAACCTTGGATTC | 2 | 2 | NC | NC |
| 258 | 472 | AAACCATAAAACCTTGGATT | 2 | 2 | NC | NC |
| 259 | 473 | GAAACCATAAAACCTTGGAT | 2 | 2 | NC | NC |
| 260 | 474 | GGAAACCATAAAACCTTGGA | 2 | 2 | NC | NC |
| 261 | 476 | TCGGAAACCATAAAACCTTG | 2 | 3 | NC | NC |

TABLE 2-continued

| Exemplary Oligonucleotides | | | | | | |
|---|---|---|---|---|---|---|
| SEQ | | | Off-target Score | | | |
| ID NO | Position | Sequence | Human | Cyno | Mouse | Rat |
| 262 | 477 | CTCGGAAACCATAAAACCTT | 3 | 3 | NC | NC |
| 263 | 478 | CCTCGGAAACCATAAAACCT | 2 | 2 | NC | NC |
| 264 | 479 | TCCTCGGAAACCATAAAACC | 2 | 2 | NC | NC |
| 265 | 480 | CTCCTCGGAAACCATAAAAC | 2 | 2 | NC | NC |
| 266 | 481 | TCTCCTCGGAAACCATAAAA | 2 | 2 | NC | NC |
| 267 | 482 | CTCTCCTCGGAAACCATAAA | 2 | 2 | NC | NC |
| 268 | 483 | CCTCTCCTCGGAAACCATAA | 2 | 2 | NC | NC |
| 269 | 484 | GCCTCTCCTCGGAAACCATA | 2 | 1 | NC | NC |
| 270 | 509 | GGCCATGTCAGCAATATTTG | 2 | NC | NC | NC |
| 271 | 510 | TGGCCATGTCAGCAATATTT | 1 | NC | NC | NC |
| 272 | 511 | CTGGCCATGTCAGCAATATT | 2 | NC | NC | NC |
| 273 | 512 | ACTGGCCATGTCAGCAATAT | 2 | NC | NC | NC |
| 274 | 513 | CACTGGCCATGTCAGCAATA | 2 | NC | NC | NC |
| 275 | 514 | GCACTGGCCATGTCAGCAAT | 2 | NC | NC | NC |
| 276 | 515 | AGCACTGGCCATGTCAGCAA | 1 | NC | NC | NC |
| 277 | 527 | CGAAATTTCCACAGCACTGG | 2 | NC | NC | NC |
| 278 | 528 | ACGAAATTTCCACAGCACTG | 2 | NC | NC | NC |
| 279 | 529 | GACGAAATTTCCACAGCACT | 2 | NC | NC | NC |
| 280 | 530 | GGACGAAATTTCCACAGCAC | 2 | NC | NC | NC |
| 281 | 531 | TGGACGAAATTTCCACAGCA | 2 | NC | NC | NC |
| 282 | 537 | TTTTCTTGGACGAAATTTCC | 2 | 2 | NC | NC |
| 283 | 538 | TTTTTCTTGGACGAAATTTC | 2 | 1 | NC | NC |
| 284 | 539 | GTTTTTCTTGGACGAAATTT | 2 | 2 | NC | NC |
| 285 | 540 | TGTTTTTCTTGGACGAAATT | 2 | 2 | NC | NC |
| 286 | 541 | CTGTTTTTCTTGGACGAAAT | 2 | 2 | NC | NC |
| 287 | 542 | CCTGTTTTTCTTGGACGAAA | 3 | 1 | NC | NC |
| 288 | 543 | TCCTGTTTTTCTTGGACGAA | 2 | 2 | NC | NC |
| 289 | 547 | ATTGTCCTGTTTTTCTTGGA | 1 | 2 | NC | NC |
| 290 | 548 | CATTGTCCTGTTTTTCTTGG | 1 | 2 | NC | NC |
| 291 | 549 | TCATTGTCCTGTTTTTCTTG | 1 | 1 | NC | NC |
| 292 | 550 | TTCATTGTCCTGTTTTTCTT | 0 | 2 | NC | NC |
| 293 | 551 | TTTCATTGTCCTGTTTTTCT | 1 | 1 | NC | NC |
| 294 | 552 | TTTTCATTGTCCTGTTTTTC | 2 | 1 | NC | NC |
| 295 | 553 | GTTTTCATTGTCCTGTTTTT | 1 | 2 | NC | NC |
| 296 | 554 | AGTTTTCATTGTCCTGTTTT | 2 | 1 | NC | NC |
| 297 | 555 | AAGTTTTCATTGTCCTGTTT | 2 | 1 | NC | NC |
| 298 | 556 | AAAGTTTTCATTGTCCTGTT | 2 | 2 | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 299 | 557 | AAAAGTTTTCATTGTCCTGT | 2 | 2 | NC | NC |
| 300 | 558 | CAAAAGTTTTCATTGTCCTG | 2 | 2 | NC | NC |
| 301 | 559 | ACAAAAGTTTTCATTGTCCT | 2 | 2 | NC | NC |
| 302 | 560 | CACAAAAGTTTTCATTGTCC | 2 | 2 | NC | NC |
| 303 | 561 | TCACAAAAGTTTTCATTGTC | 1 | 1 | NC | NC |
| 304 | 562 | TTCACAAAAGTTTTCATTGT | 1 | 1 | NC | NC |
| 305 | 563 | TTTCACAAAAGTTTTCATTG | 2 | 1 | NC | NC |
| 306 | 564 | GTTTCACAAAAGTTTTCATT | 2 | 2 | NC | NC |
| 307 | 565 | AGTTTCACAAAAGTTTTCAT | 1 | 2 | NC | NC |
| 308 | 566 | CAGTTTCACAAAAGTTTTCA | 1 | 1 | NC | NC |
| 309 | 567 | ACAGTTTCACAAAAGTTTTC | 2 | 2 | NC | NC |
| 310 | 568 | AACAGTTTCACAAAAGTTTT | 1 | 1 | NC | NC |
| 311 | 569 | AAACAGTTTCACAAAAGTTT | 2 | 2 | NC | NC |
| 312 | 580 | TTTCCACTCTGAAACAGTTT | 1 | 2 | NC | NC |
| 313 | 581 | TTTTCCACTCTGAAACAGTT | 1 | 2 | NC | NC |
| 314 | 582 | CTTTTCCACTCTGAAACAGT | 2 | 2 | NC | NC |
| 315 | 583 | GCTTTTCCACTCTGAAACAG | 2 | 2 | NC | NC |
| 316 | 584 | GGCTTTTCCACTCTGAAACA | 2 | 1 | NC | NC |
| 317 | 585 | GGGCTTTTCCACTCTGAAAC | 2 | 2 | NC | NC |
| 318 | 586 | AGGGCTTTTCCACTCTGAAA | 2 | 2 | NC | NC |
| 319 | 587 | CAGGGCTTTTCCACTCTGAA | 2 | 2 | NC | NC |
| 320 | 588 | TCAGGGCTTTTCCACTCTGA | 2 | 2 | NC | NC |
| 321 | 589 | TTCAGGGCTTTTCCACTCTG | 2 | 2 | NC | NC |
| 322 | 590 | TTTCAGGGCTTTTCCACTCT | 2 | 1 | NC | NC |
| 323 | 591 | CTTTCAGGGCTTTTCCACTC | 1 | 1 | NC | NC |
| 324 | 592 | GCTTTCAGGGCTTTTCCACT | 1 | 1 | NC | NC |
| 325 | 593 | AGCTTTCAGGGCTTTTCCAC | 1 | 2 | NC | NC |
| 326 | 611 | AGTCACATCAGCTTCACAAG | 2 | 2 | NC | NC |
| 327 | 612 | TAGTCACATCAGCTTCACAA | 2 | 2 | NC | NC |
| 328 | 613 | CTAGTCACATCAGCTTCACA | 3 | 3 | NC | NC |
| 329 | 614 | TCTAGTCACATCAGCTTCAC | 2 | 2 | NC | NC |
| 330 | 615 | CTCTAGTCACATCAGCTTCA | 2 | NC | NC | NC |
| 331 | 616 | GCTCTAGTCACATCAGCTTC | 2 | NC | NC | NC |
| 332 | 617 | TGCTCTAGTCACATCAGCTT | 2 | NC | NC | NC |
| 333 | 618 | TTGCTCTAGTCACATCAGCT | 2 | NC | NC | NC |
| 334 | 619 | CTTGCTCTAGTCACATCAGC | 2 | NC | NC | NC |
| 335 | 620 | GCTTGCTCTAGTCACATCAG | 2 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 336 | 621 | CGCTTGCTCTAGTCACATCA | 2 | NC | NC | NC |
| 337 | 622 | GCGCTTGCTCTAGTCACATC | 2 | NC | NC | NC |
| 338 | 635 | TACAGTAGTCCCAGCGCTTG | 2 | NC | NC | NC |
| 339 | 636 | TTACAGTAGTCCCAGCGCTT | 2 | NC | NC | NC |
| 340 | 637 | GTTACAGTAGTCCCAGCGCT | 3 | NC | NC | NC |
| 341 | 638 | TGTTACAGTAGTCCCAGCGC | 2 | NC | NC | NC |
| 342 | 639 | CTGTTACAGTAGTCCCAGCG | 2 | NC | NC | NC |
| 343 | 651 | ATAGGTTATACACTGTTACA | 1 | 2 | NC | NC |
| 344 | 652 | AATAGGTTATACACTGTTAC | 2 | 2 | NC | NC |
| 345 | 653 | AAATAGGTTATACACTGTTA | 1 | 1 | NC | NC |
| 346 | 654 | AAAATAGGTTATACACTGTT | 2 | 1 | NC | NC |
| 347 | 655 | TAAAATAGGTTATACACTGT | 1 | 1 | NC | NC |
| 348 | 656 | GTAAAATAGGTTATACACTG | 2 | 2 | NC | NC |
| 349 | 657 | GGTAAAATAGGTTATACACT | 1 | 1 | NC | NC |
| 350 | 658 | TGGTAAAATAGGTTATACAC | 2 | 2 | NC | NC |
| 351 | 659 | CTGGTAAAATAGGTTATACA | 2 | 2 | NC | NC |
| 352 | 660 | GCTGGTAAAATAGGTTATAC | 2 | 2 | NC | NC |
| 353 | 661 | AGCTGGTAAAATAGGTTATA | 2 | 2 | NC | NC |
| 354 | 662 | AAGCTGGTAAAATAGGTTAT | 1 | NC | NC | NC |
| 355 | 663 | GAAGCTGGTAAAATAGGTTA | 1 | NC | NC | NC |
| 356 | 664 | GGAAGCTGGTAAAATAGGTT | 1 | NC | NC | NC |
| 357 | 665 | AGGAAGCTGGTAAAATAGGT | 1 | NC | NC | NC |
| 358 | 666 | CAGGAAGCTGGTAAAATAGG | 1 | NC | NC | NC |
| 359 | 667 | ACAGGAAGCTGGTAAAATAG | 2 | NC | NC | NC |
| 360 | 668 | TACAGGAAGCTGGTAAAATA | 2 | NC | NC | NC |
| 361 | 669 | TTACAGGAAGCTGGTAAAAT | 2 | NC | NC | NC |
| 362 | 670 | CTTACAGGAAGCTGGTAAAA | 2 | NC | NC | NC |
| 363 | 671 | CCTTACAGGAAGCTGGTAAA | 2 | NC | NC | NC |
| 364 | 682 | ATGCATTTCCTCCTTACAGG | 2 | 2 | NC | NC |
| 365 | 683 | CATGCATTTCCTCCTTACAG | 2 | 2 | NC | NC |
| 366 | 684 | CCATGCATTTCCTCCTTACA | 2 | 2 | NC | NC |
| 367 | 685 | TCCATGCATTTCCTCCTTAC | 2 | 2 | NC | NC |
| 368 | 686 | GTCCATGCATTTCCTCCTTA | 2 | 2 | NC | NC |
| 369 | 687 | GGTCCATGCATTTCCTCCTT | 1 | 1 | NC | NC |
| 370 | 688 | GGGTCCATGCATTTCCTCCT | 2 | 2 | NC | NC |
| 371 | 689 | AGGGTCCATGCATTTCCTCC | 1 | 1 | NC | NC |
| 372 | 690 | TAGGGTCCATGCATTTCCTC | 2 | 2 | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 373 | 691 | CTAGGGTCCATGCATTTCCT | 3 | 3 | NC | NC |
| 374 | 692 | TCTAGGGTCCATGCATTTCC | 2 | 2 | NC | NC |
| 375 | 693 | GTCTAGGGTCCATGCATTTC | 2 | 3 | NC | NC |
| 376 | 694 | AGTCTAGGGTCCATGCATTT | 2 | 2 | NC | NC |
| 377 | 695 | CAGTCTAGGGTCCATGCATT | 2 | 3 | NC | NC |
| 378 | 696 | CCAGTCTAGGGTCCATGCAT | 2 | 2 | NC | NC |
| 379 | 697 | TCCAGTCTAGGGTCCATGCA | 2 | 2 | NC | NC |
| 380 | 699 | ACTCCAGTCTAGGGTCCATG | 1 | 2 | NC | NC |
| 381 | 700 | AACTCCAGTCTAGGGTCCAT | 2 | 2 | NC | NC |
| 382 | 701 | AAACTCCAGTCTAGGGTCCA | 2 | 2 | NC | NC |
| 383 | 702 | CAAACTCCAGTCTAGGGTCC | 2 | 2 | NC | NC |
| 384 | 703 | TCAAACTCCAGTCTAGGGTC | 2 | 2 | NC | NC |
| 385 | 704 | CTCAAACTCCAGTCTAGGGT | 2 | 2 | NC | NC |
| 386 | 705 | TCTCAAACTCCAGTCTAGGG | 2 | 2 | NC | NC |
| 387 | 706 | TTCTCAAACTCCAGTCTAGG | 2 | 2 | NC | NC |
| 388 | 707 | CTTCTCAAACTCCAGTCTAG | 2 | 2 | NC | NC |
| 389 | 708 | CCTTCTCAAACTCCAGTCTA | 2 | 2 | NC | NC |
| 390 | 709 | ACCTTCTCAAACTCCAGTCT | 2 | 2 | NC | NC |
| 391 | 710 | AACCTTCTCAAACTCCAGTC | 2 | 2 | NC | NC |
| 392 | 711 | TAACCTTCTCAAACTCCAGT | 2 | 1 | NC | NC |
| 393 | 712 | CTAACCTTCTCAAACTCCAG | 2 | 2 | NC | NC |
| 394 | 713 | CCTAACCTTCTCAAACTCCA | 2 | 1 | NC | NC |
| 395 | 714 | GCCTAACCTTCTCAAACTCC | 2 | 2 | NC | NC |
| 396 | 715 | TGCCTAACCTTCTCAAACTC | 2 | 2 | NC | NC |
| 397 | 716 | CTGCCTAACCTTCTCAAACT | 2 | 1 | NC | NC |
| 398 | 717 | TCTGCCTAACCTTCTCAAAC | 2 | 1 | NC | NC |
| 399 | 718 | CTCTGCCTAACCTTCTCAAA | 2 | 2 | NC | NC |
| 400 | 719 | TCTCTGCCTAACCTTCTCAA | 2 | NC | NC | NC |
| 401 | 720 | TTCTCTGCCTAACCTTCTCA | 2 | NC | NC | NC |
| 402 | 721 | ATTCTCTGCCTAACCTTCTC | 2 | NC | NC | NC |
| 403 | 722 | TATTCTCTGCCTAACCTTCT | 2 | NC | NC | NC |
| 404 | 723 | CTATTCTCTGCCTAACCTTC | 2 | NC | NC | NC |
| 405 | 724 | TCTATTCTCTGCCTAACCTT | 2 | NC | NC | NC |
| 406 | 725 | TTCTATTCTCTGCCTAACCT | 2 | NC | NC | NC |
| 407 | 726 | CTTCTATTCTCTGCCTAACC | 2 | NC | NC | NC |
| 408 | 727 | GCTTCTATTCTCTGCCTAAC | 1 | NC | NC | NC |
| 409 | 728 | AGCTTCTATTCTCTGCCTAA | 1 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 410 | 729 | GAGCTTCTATTCTCTGCCTA | 2 | NC | NC | NC |
| 411 | 730 | AGAGCTTCTATTCTCTGCCT | 1 | NC | NC | NC |
| 412 | 731 | GAGAGCTTCTATTCTCTGCC | 2 | NC | NC | NC |
| 413 | 736 | AGTGAGAGAGCTTCTATTCT | 2 | NC | NC | NC |
| 414 | 737 | GAGTGAGAGAGCTTCTATTC | 2 | NC | NC | NC |
| 415 | 738 | TGAGTGAGAGAGCTTCTATT | 2 | NC | NC | NC |
| 416 | 739 | ATGAGTGAGAGAGCTTCTAT | 2 | NC | NC | NC |
| 417 | 740 | CATGAGTGAGAGAGCTTCTA | 2 | NC | NC | NC |
| 418 | 742 | TGCATGAGTGAGAGAGCTTC | 2 | NC | NC | NC |
| 419 | 743 | GTGCATGAGTGAGAGAGCTT | 1 | NC | NC | NC |
| 420 | 744 | GGTGCATGAGTGAGAGAGCT | 1 | NC | NC | NC |
| 421 | 746 | AGGGTGCATGAGTGAGAGAG | 2 | NC | NC | NC |
| 422 | 747 | AAGGGTGCATGAGTGAGAGA | 1 | NC | NC | NC |
| 423 | 748 | GAAGGGTGCATGAGTGAGAG | 1 | NC | NC | NC |
| 424 | 749 | GGAAGGGTGCATGAGTGAGA | 1 | NC | NC | NC |
| 425 | 750 | TGGAAGGGTGCATGAGTGAG | 2 | NC | NC | NC |
| 426 | 751 | ATGGAAGGGTGCATGAGTGA | 2 | NC | NC | NC |
| 427 | 752 | AATGGAAGGGTGCATGAGTG | 2 | NC | NC | NC |
| 428 | 753 | AAATGGAAGGGTGCATGAGT | 2 | NC | NC | NC |
| 429 | 754 | GAAATGGAAGGGTGCATGAG | 1 | NC | NC | NC |
| 430 | 755 | AGAAATGGAAGGGTGCATGA | 2 | NC | NC | NC |
| 431 | 756 | AAGAAATGGAAGGGTGCATG | 2 | NC | NC | NC |
| 432 | 757 | AAAGAAATGGAAGGGTGCAT | 2 | NC | NC | NC |
| 433 | 758 | GAAAGAAATGGAAGGGTGCA | 2 | NC | NC | NC |
| 434 | 759 | AGAAAGAAATGGAAGGGTGC | 2 | NC | NC | NC |
| 435 | 760 | GAGAAAGAAATGGAAGGGTG | 1 | NC | NC | NC |
| 436 | 761 | AGAGAAAGAAATGGAAGGGT | 1 | NC | NC | NC |
| 437 | 762 | AAGAGAAAGAAATGGAAGGG | 1 | NC | NC | NC |
| 438 | 763 | AAAGAGAAAGAAATGGAAGG | 0 | NC | NC | NC |
| 439 | 764 | CAAAGAGAAAGAAATGGAAG | 1 | NC | NC | NC |
| 440 | 765 | TCAAAGAGAAAGAAATGGAA | 1 | NC | NC | NC |
| 441 | 766 | CTCAAAGAGAAAGAAATGGA | 1 | NC | NC | NC |
| 442 | 767 | TCTCAAAGAGAAAGAAATGG | 2 | NC | NC | NC |
| 443 | 776 | AACATCATTTCTCAAAGAGA | 1 | 2 | NC | NC |
| 444 | 777 | AAACATCATTTCTCAAAGAG | 2 | 2 | NC | NC |
| 445 | 778 | GAAACATCATTTCTCAAAGA | 1 | 2 | NC | NC |
| 446 | 779 | AGAAACATCATTTCTCAAAG | 1 | 1 | NC | NC |

TABLE 2-continued

| Exemplary Oligonucleotides | | | | | | |
|---|---|---|---|---|---|---|
| SEQ | | | Off-target Score | | | |
| ID NO | Position | Sequence | Human | Cyno | Mouse | Rat |
| 447 | 780 | CAGAAACATCATTTCTCAAA | 0 | 1 | NC | NC |
| 448 | 781 | CCAGAAACATCATTTCTCAA | 0 | 1 | NC | NC |
| 449 | 782 | ACCAGAAACATCATTTCTCA | 1 | 0 | NC | NC |
| 450 | 783 | AACCAGAAACATCATTTCTC | 1 | 1 | NC | NC |
| 451 | 785 | GGAACCAGAAACATCATTTC | 1 | 1 | NC | NC |
| 452 | 786 | TGGAACCAGAAACATCATTT | 1 | 1 | NC | NC |
| 453 | 787 | ATGGAACCAGAAACATCATT | 2 | 1 | NC | NC |
| 454 | 788 | CATGGAACCAGAAACATCAT | 2 | 2 | NC | NC |
| 455 | 789 | CCATGGAACCAGAAACATCA | 2 | 2 | NC | NC |
| 456 | 790 | ACCATGGAACCAGAAACATC | 2 | 2 | NC | NC |
| 457 | 791 | AACCATGGAACCAGAAACAT | 2 | 2 | NC | NC |
| 458 | 792 | GAACCATGGAACCAGAAACA | 1 | 2 | NC | NC |
| 459 | 793 | AGAACCATGGAACCAGAAAC | 2 | 2 | NC | NC |
| 460 | 794 | AAGAACCATGGAACCAGAAA | 2 | 1 | NC | NC |
| 461 | 795 | GAAGAACCATGGAACCAGAA | 2 | 2 | NC | NC |
| 462 | 796 | TGAAGAACCATGGAACCAGA | 1 | 1 | NC | NC |
| 463 | 797 | CTGAAGAACCATGGAACCAG | 2 | NC | NC | NC |
| 464 | 798 | GCTGAAGAACCATGGAACCA | 2 | NC | NC | NC |
| 465 | 799 | AGCTGAAGAACCATGGAACC | 2 | NC | NC | NC |
| 466 | 800 | GAGCTGAAGAACCATGGAAC | 2 | NC | NC | NC |
| 467 | 801 | GGAGCTGAAGAACCATGGAA | 2 | NC | NC | NC |
| 468 | 802 | GGGAGCTGAAGAACCATGGA | 2 | NC | NC | NC |
| 469 | 803 | AGGGAGCTGAAGAACCATGG | 2 | NC | NC | NC |
| 470 | 804 | TAGGGAGCTGAAGAACCATG | 2 | NC | NC | NC |
| 471 | 805 | TTAGGGAGCTGAAGAACCAT | 2 | NC | NC | NC |
| 472 | 806 | TTTAGGGAGCTGAAGAACCA | 2 | NC | NC | NC |
| 473 | 807 | TTTTAGGGAGCTGAAGAACC | 2 | NC | NC | NC |
| 474 | 808 | GTTTTAGGGAGCTGAAGAAC | 2 | NC | NC | NC |
| 475 | 809 | GGTTTTAGGGAGCTGAAGAA | 2 | NC | NC | NC |
| 476 | 810 | TGGTTTTAGGGAGCTGAAGA | 2 | NC | NC | NC |
| 477 | 811 | TTGGTTTTAGGGAGCTGAAG | 2 | NC | NC | NC |
| 478 | 812 | TTTGGTTTTAGGGAGCTGAA | 2 | NC | NC | NC |
| 479 | 813 | CTTTGGTTTTAGGGAGCTGA | 2 | NC | NC | NC |
| 480 | 814 | TCTTTGGTTTTAGGGAGCTG | 1 | NC | NC | NC |
| 481 | 815 | GTCTTTGGTTTTAGGGAGCT | 2 | NC | NC | NC |
| 482 | 816 | CGTCTTTGGTTTTAGGGAGC | 2 | NC | NC | NC |
| 483 | 817 | ACGTCTTTGGTTTTAGGGAG | 2 | 2 | NC | NC |

TABLE 2-continued

| Exemplary Oligonucleotides | | | | | | |
|---|---|---|---|---|---|---|
| SEQ | | | Off-target Score | | | |
| ID NO | Position | Sequence | Human | Cyno | Mouse | Rat |
| 484 | 818 | TACGTCTTTGGTTTTAGGGA | 2 | 2 | NC | NC |
| 485 | 819 | ATACGTCTTTGGTTTTAGGG | 2 | 2 | NC | NC |
| 486 | 820 | CATACGTCTTTGGTTTTAGG | 2 | 2 | NC | NC |
| 487 | 821 | ACATACGTCTTTGGTTTTAG | 2 | 2 | NC | NC |
| 488 | 822 | AACATACGTCTTTGGTTTTA | 2 | 2 | NC | NC |
| 489 | 823 | GAACATACGTCTTTGGTTTT | 2 | 2 | NC | NC |
| 490 | 824 | GGAACATACGTCTTTGGTTT | 3 | 3 | NC | NC |
| 491 | 825 | GGGAACATACGTCTTTGGTT | 2 | 3 | NC | NC |
| 492 | 826 | CGGGAACATACGTCTTTGGT | 3 | 3 | NC | NC |
| 493 | 827 | TCGGGAACATACGTCTTTGG | 3 | 3 | NC | NC |
| 494 | 828 | ATCGGGAACATACGTCTTTG | 3 | 2 | NC | NC |
| 495 | 829 | AATCGGGAACATACGTCTTT | 2 | 2 | NC | NC |
| 496 | 830 | AAATCGGGAACATACGTCTT | 2 | 2 | NC | NC |
| 497 | 831 | AAAATCGGGAACATACGTCT | 3 | 2 | NC | NC |
| 498 | 832 | CAAAATCGGGAACATACGTC | 3 | 3 | NC | NC |
| 499 | 833 | ACAAAATCGGGAACATACGT | 3 | 3 | NC | NC |
| 500 | 834 | GACAAAATCGGGAACATACG | 3 | 3 | NC | NC |
| 501 | 835 | TGACAAAATCGGGAACATAC | 2 | 2 | NC | NC |
| 502 | 836 | TTGACAAAATCGGGAACATA | 2 | 2 | NC | NC |
| 503 | 837 | TTTGACAAAATCGGGAACAT | 2 | 2 | NC | NC |
| 504 | 838 | ATTTGACAAAATCGGGAACA | 2 | 2 | NC | NC |
| 505 | 839 | AATTTGACAAAATCGGGAAC | 2 | 2 | NC | NC |
| 506 | 840 | AAATTTGACAAAATCGGGAA | 2 | 2 | NC | NC |
| 507 | 841 | TAAATTTGACAAAATCGGGA | 2 | 2 | NC | NC |
| 508 | 842 | ATAAATTTGACAAAATCGGG | 2 | 2 | NC | NC |
| 509 | 843 | CATAAATTTGACAAAATCGG | 2 | 2 | NC | NC |
| 510 | 844 | CCATAAATTTGACAAAATCG | 2 | 2 | NC | NC |
| 511 | 845 | TCCATAAATTTGACAAAATC | 2 | 1 | NC | NC |
| 512 | 848 | CAATCCATAAATTTGACAAA | 1 | 2 | NC | NC |
| 513 | 849 | CCAATCCATAAATTTGACAA | 2 | 2 | NC | NC |
| 514 | 850 | CCCAATCCATAAATTTGACA | 2 | 2 | NC | NC |
| 515 | 851 | TCCCAATCCATAAATTTGAC | 2 | 2 | NC | NC |
| 516 | 852 | TTCCCAATCCATAAATTTGA | 2 | 1 | NC | NC |
| 517 | 853 | TTTCCCAATCCATAAATTTG | 2 | 1 | NC | NC |
| 518 | 854 | CTTTCCCAATCCATAAATTT | 1 | 1 | NC | NC |
| 519 | 855 | ACTTTCCCAATCCATAAATT | 1 | 2 | NC | NC |
| 520 | 856 | GACTTTCCCAATCCATAAAT | 2 | 2 | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 521 | 857 | GGACTTTCCCAATCCATAAA | 2 | 2 | NC | NC |
| 522 | 868 | CTTAGCTTTTGGGACTTTCC | 2 | NC | NC | NC |
| 523 | 869 | TCTTAGCTTTTGGGACTTTC | 2 | NC | NC | NC |
| 524 | 870 | CTCTTAGCTTTTGGGACTTT | 2 | NC | NC | NC |
| 525 | 871 | TCTCTTAGCTTTTGGGACTT | 2 | NC | NC | NC |
| 526 | 872 | TTCTCTTAGCTTTTGGGACT | 2 | NC | NC | NC |
| 527 | 873 | TTTCTCTTAGCTTTTGGGAC | 2 | NC | NC | NC |
| 528 | 874 | ATTTCTCTTAGCTTTTGGGA | 2 | NC | NC | NC |
| 529 | 875 | TATTTCTCTTAGCTTTTGGG | 2 | NC | NC | NC |
| 530 | 876 | TTATTTCTCTTAGCTTTTGG | 2 | NC | NC | NC |
| 531 | 877 | CTTATTTCTCTTAGCTTTTG | 2 | NC | NC | NC |
| 532 | 878 | ACTTATTTCTCTTAGCTTTT | 2 | NC | NC | NC |
| 533 | 879 | AACTTATTTCTCTTAGCTTT | 1 | NC | NC | NC |
| 534 | 880 | AAACTTATTTCTCTTAGCTT | 1 | NC | NC | NC |
| 535 | 881 | AAAACTTATTTCTCTTAGCT | 2 | NC | NC | NC |
| 536 | 882 | TAAAACTTATTTCTCTTAGC | 2 | NC | NC | NC |
| 537 | 900 | GCTCAAACTCTTTATATTTA | 2 | NC | NC | NC |
| 538 | 901 | AGCTCAAACTCTTTATATTT | 1 | NC | NC | NC |
| 539 | 902 | AAGCTCAAACTCTTTATATT | 2 | NC | NC | NC |
| 540 | 903 | TAAGCTCAAACTCTTTATAT | 1 | NC | NC | NC |
| 541 | 904 | CTAAGCTCAAACTCTTTATA | 1 | NC | NC | NC |
| 542 | 905 | ACTAAGCTCAAACTCTTTAT | 2 | NC | NC | NC |
| 543 | 906 | CACTAAGCTCAAACTCTTTA | 2 | NC | NC | NC |
| 544 | 907 | CCACTAAGCTCAAACTCTTT | 2 | NC | NC | NC |
| 545 | 908 | GCCACTAAGCTCAAACTCTT | 2 | NC | NC | NC |
| 546 | 909 | AGCCACTAAGCTCAAACTCT | 2 | NC | NC | NC |
| 547 | 936 | TGTTGTAATGTGCTTCAGAG | 2 | NC | NC | NC |
| 548 | 937 | TTGTTGTAATGTGCTTCAGA | 2 | NC | NC | NC |
| 549 | 938 | CTTGTTGTAATGTGCTTCAG | 2 | NC | NC | NC |
| 550 | 939 | TCTTGTTGTAATGTGCTTCA | 2 | NC | NC | NC |
| 551 | 940 | TTCTTGTTGTAATGTGCTTC | 2 | NC | NC | NC |
| 552 | 941 | ATTCTTGTTGTAATGTGCTT | 2 | NC | NC | NC |
| 553 | 942 | TATTCTTGTTGTAATGTGCT | 2 | NC | NC | NC |
| 554 | 943 | ATATTCTTGTTGTAATGTGC | 1 | NC | NC | NC |
| 555 | 944 | CATATTCTTGTTGTAATGTG | 1 | NC | NC | NC |
| 556 | 945 | GCATATTCTTGTTGTAATGT | 1 | NC | NC | NC |
| 557 | 946 | TGCATATTCTTGTTGTAATG | 2 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 558 | 947 | CTGCATATTCTTGTTGTAAT | 2 | NC | NC | NC |
| 559 | 948 | ACTGCATATTCTTGTTGTAA | 2 | NC | NC | NC |
| 560 | 949 | AACTGCATATTCTTGTTGTA | 2 | NC | NC | NC |
| 561 | 950 | AAACTGCATATTCTTGTTGT | 2 | NC | NC | NC |
| 562 | 951 | AAAACTGCATATTCTTGTTG | 2 | NC | NC | NC |
| 563 | 952 | AAAAACTGCATATTCTTGTT | 2 | NC | NC | NC |
| 564 | 953 | CAAAAACTGCATATTCTTGT | 1 | NC | NC | NC |
| 565 | 954 | ACAAAAACTGCATATTCTTG | 2 | NC | NC | NC |
| 566 | 955 | AACAAAAACTGCATATTCTT | 1 | 2 | 1 | 2 |
| 567 | 956 | AAACAAAAACTGCATATTCT | 1 | 1 | 1 | 2 |
| 568 | 957 | CAAACAAAAACTGCATATTC | 2 | 2 | 2 | 1 |
| 569 | 958 | ACAAACAAAAACTGCATATT | 1 | 1 | 1 | 2 |
| 570 | 959 | CACAAACAAAAACTGCATAT | 1 | 1 | 2 | 2 |
| 571 | 960 | TCACAAACAAAAACTGCATA | 0 | 1 | 2 | 2 |
| 572 | 961 | TTCACAAACAAAAACTGCAT | 0 | 2 | 2 | 2 |
| 573 | 962 | GTTCACAAACAAAAACTGCA | 1 | 2 | 1 | 2 |
| 574 | 974 | AACTAGTCTTTTGTTCACAA | 1 | NC | NC | NC |
| 575 | 975 | AAACTAGTCTTTTGTTCACA | 1 | NC | NC | NC |
| 576 | 976 | AAAACTAGTCTTTTGTTCAC | 1 | NC | NC | NC |
| 577 | 977 | TAAAACTAGTCTTTTGTTCA | 1 | NC | NC | NC |
| 578 | 978 | TTAAAACTAGTCTTTTGTTC | 1 | NC | NC | NC |
| 579 | 979 | CTTAAAACTAGTCTTTTGTT | 1 | NC | NC | NC |
| 580 | 980 | CCTTAAAACTAGTCTTTTGT | 2 | NC | NC | NC |
| 581 | 981 | TCCTTAAAACTAGTCTTTTG | 2 | NC | NC | NC |
| 582 | 982 | GTCCTTAAAACTAGTCTTTT | 2 | NC | NC | NC |
| 583 | 983 | TGTCCTTAAAACTAGTCTTT | 2 | NC | NC | NC |
| 584 | 984 | TTGTCCTTAAAACTAGTCTT | 2 | NC | NC | NC |
| 585 | 985 | TTTGTCCTTAAAACTAGTCT | 1 | NC | NC | NC |
| 586 | 986 | CTTTGTCCTTAAAACTAGTC | 2 | NC | NC | NC |
| 587 | 987 | GCTTTGTCCTTAAAACTAGT | 1 | NC | NC | NC |
| 588 | 988 | AGCTTTGTCCTTAAAACTAG | 2 | NC | NC | NC |
| 589 | 989 | TAGCTTTGTCCTTAAAACTA | 2 | NC | NC | NC |
| 590 | 990 | GTAGCTTTGTCCTTAAAACT | 2 | NC | NC | NC |
| 591 | 991 | TGTAGCTTTGTCCTTAAAAC | 2 | 2 | NC | NC |
| 592 | 992 | ATGTAGCTTTGTCCTTAAAA | 1 | 2 | NC | NC |
| 593 | 993 | TATGTAGCTTTGTCCTTAAA | 2 | 2 | NC | NC |
| 594 | 994 | TTATGTAGCTTTGTCCTTAA | 2 | 2 | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 595 | 995 | TTTATGTAGCTTTGTCCTTA | 1 | 2 | NC | NC |
| 596 | 996 | GTTTATGTAGCTTTGTCCTT | 2 | 2 | NC | NC |
| 597 | 997 | AGTTTATGTAGCTTTGTCCT | 3 | 2 | NC | NC |
| 598 | 998 | GAGTTTATGTAGCTTTGTCC | 2 | 2 | NC | NC |
| 599 | 999 | TGAGTTTATGTAGCTTTGTC | 2 | 2 | NC | NC |
| 600 | 1000 | ATGAGTTTATGTAGCTTTGT | 2 | 1 | NC | NC |
| 601 | 1001 | AATGAGTTTATGTAGCTTTG | 1 | 1 | NC | NC |
| 602 | 1002 | CAATGAGTTTATGTAGCTTT | 2 | 2 | NC | NC |
| 603 | 1003 | TCAATGAGTTTATGTAGCTT | 1 | 1 | NC | NC |
| 604 | 1004 | GTCAATGAGTTTATGTAGCT | 2 | 2 | NC | NC |
| 605 | 1005 | AGTCAATGAGTTTATGTAGC | 2 | 2 | NC | NC |
| 606 | 1006 | AAGTCAATGAGTTTATGTAG | 2 | 2 | NC | NC |
| 607 | 1007 | AAAGTCAATGAGTTTATGTA | 2 | 2 | NC | NC |
| 608 | 1008 | AAAAGTCAATGAGTTTATGT | 2 | 2 | NC | NC |
| 609 | 1009 | AAAAAGTCAATGAGTTTATG | 1 | 2 | NC | NC |
| 610 | 1015 | CTTAATAAAAAGTCAATGAG | 2 | 1 | NC | NC |
| 611 | 1016 | CCTTAATAAAAAGTCAATGA | 1 | 2 | NC | NC |
| 612 | 1017 | TCCTTAATAAAAAGTCAATG | 2 | 2 | NC | NC |
| 613 | 1020 | CTTTCCTTAATAAAAAGTCA | 1 | 2 | NC | NC |
| 614 | 1021 | TCTTTCCTTAATAAAAAGTC | 0 | 2 | NC | NC |
| 615 | 1033 | CATATAATACTTTCTTTCCT | 1 | NC | NC | NC |
| 616 | 1034 | GCATATAATACTTTCTTTCC | 1 | NC | NC | NC |
| 617 | 1035 | TGCATATAATACTTTCTTTC | 2 | NC | NC | NC |
| 618 | 1037 | CTTGCATATAATACTTTCTT | 2 | NC | NC | NC |
| 619 | 1038 | GCTTGCATATAATACTTTCT | 2 | NC | NC | NC |
| 620 | 1039 | GGCTTGCATATAATACTTTC | 3 | NC | NC | NC |
| 621 | 1040 | TGGCTTGCATATAATACTTT | 3 | NC | NC | NC |
| 622 | 1041 | TTGGCTTGCATATAATACTT | 2 | NC | NC | NC |
| 623 | 1042 | TTTGGCTTGCATATAATACT | 1 | 1 | NC | NC |
| 624 | 1043 | CTTTGGCTTGCATATAATAC | 2 | 2 | NC | NC |
| 625 | 1044 | TCTTTGGCTTGCATATAATA | 2 | 2 | NC | NC |
| 626 | 1045 | TTCTTTGGCTTGCATATAAT | 1 | 2 | NC | NC |
| 627 | 1046 | ATTCTTTGGCTTGCATATAA | 1 | NC | NC | NC |
| 628 | 1047 | CATTCTTTGGCTTGCATATA | 2 | NC | NC | NC |
| 629 | 1048 | CCATTCTTTGGCTTGCATAT | 1 | NC | NC | NC |
| 630 | 1067 | CATTTGCCTACTGGTGGGAC | 2 | NC | NC | NC |
| 631 | 1068 | TCATTTGCCTACTGGTGGGA | 2 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 632 | 1069 | TTCATTTGCCTACTGGTGGG | 2 | NC | NC | NC |
| 633 | 1070 | ATTCATTTGCCTACTGGTGG | 1 | NC | NC | NC |
| 634 | 1071 | AATTCATTTGCCTACTGGTG | 2 | NC | NC | NC |
| 635 | 1072 | GAATTCATTTGCCTACTGGT | 2 | NC | NC | NC |
| 636 | 1073 | TGAATTCATTTGCCTACTGG | 2 | NC | NC | NC |
| 637 | 1074 | TTGAATTCATTTGCCTACTG | 1 | NC | NC | NC |
| 638 | 1075 | CTTGAATTCATTTGCCTACT | 1 | NC | NC | NC |
| 639 | 1076 | ACTTGAATTCATTTGCCTAC | 2 | NC | NC | NC |
| 640 | 1077 | GACTTGAATTCATTTGCCTA | 1 | NC | NC | NC |
| 641 | 1078 | AGACTTGAATTCATTTGCCT | 2 | NC | NC | NC |
| 642 | 1079 | AAGACTTGAATTCATTTGCC | 1 | NC | NC | NC |
| 643 | 1080 | GAAGACTTGAATTCATTTGC | 2 | NC | NC | NC |
| 644 | 1081 | CGAAGACTTGAATTCATTTG | 2 | NC | NC | NC |
| 645 | 1082 | CCGAAGACTTGAATTCATTT | 2 | NC | NC | NC |
| 646 | 1083 | GCCGAAGACTTGAATTCATT | 3 | NC | NC | NC |
| 647 | 1084 | TGCCGAAGACTTGAATTCAT | 2 | NC | NC | NC |
| 648 | 1085 | GTGCCGAAGACTTGAATTCA | 2 | NC | NC | NC |
| 649 | 1086 | GGTGCCGAAGACTTGAATTC | 2 | NC | NC | NC |
| 650 | 1113 | ATATGCCATAGAGTTCTGGG | 2 | 2 | NC | NC |
| 651 | 1114 | TATATGCCATAGAGTTCTGG | 2 | 2 | NC | NC |
| 652 | 1115 | ATATATGCCATAGAGTTCTG | 2 | 2 | NC | NC |
| 653 | 1116 | CATATATGCCATAGAGTTCT | 2 | 2 | NC | NC |
| 654 | 1117 | ACATATATGCCATAGAGTTC | 2 | 2 | NC | NC |
| 655 | 1118 | TACATATATGCCATAGAGTT | 2 | 2 | NC | NC |
| 656 | 1119 | TTACATATATGCCATAGAGT | 1 | 2 | NC | NC |
| 657 | 1120 | ATTACATATATGCCATAGAG | 2 | 2 | NC | NC |
| 658 | 1121 | AATTACATATATGCCATAGA | 1 | 2 | NC | NC |
| 659 | 1122 | TAATTACATATATGCCATAG | 2 | 2 | NC | NC |
| 660 | 1125 | CATTAATTACATATATGCCA | 2 | 2 | NC | NC |
| 661 | 1126 | ACATTAATTACATATATGCC | 2 | 2 | NC | NC |
| 662 | 1127 | CACATTAATTACATATATGC | 2 | 1 | NC | NC |
| 663 | 1128 | GCACATTAATTACATATATG | 1 | 2 | NC | NC |
| 664 | 1130 | CTGCACATTAATTACATATA | 1 | 1 | NC | NC |
| 665 | 1131 | ACTGCACATTAATTACATAT | 1 | 2 | NC | NC |
| 666 | 1132 | CACTGCACATTAATTACATA | 2 | 2 | NC | NC |
| 667 | 1133 | GCACTGCACATTAATTACAT | 2 | 1 | NC | NC |
| 668 | 1134 | GGCACTGCACATTAATTACA | 1 | 1 | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 669 | 1135 | TGGCACTGCACATTAATTAC | 2 | 2 | NC | NC |
| 670 | 1136 | TTGGCACTGCACATTAATTA | 2 | 2 | NC | NC |
| 671 | 1137 | ATTGGCACTGCACATTAATT | 2 | 2 | NC | NC |
| 672 | 1138 | AATTGGCACTGCACATTAAT | 2 | 2 | NC | NC |
| 673 | 1139 | GAATTGGCACTGCACATTAA | 2 | 2 | NC | NC |
| 674 | 1140 | AGAATTGGCACTGCACATTA | 2 | 2 | NC | NC |
| 675 | 1141 | CAGAATTGGCACTGCACATT | 2 | 2 | NC | NC |
| 676 | 1142 | ACAGAATTGGCACTGCACAT | 2 | 2 | NC | NC |
| 677 | 1143 | CACAGAATTGGCACTGCACA | 2 | 2 | NC | NC |
| 678 | 1144 | TCACAGAATTGGCACTGCAC | 1 | 2 | NC | NC |
| 679 | 1145 | CTCACAGAATTGGCACTGCA | 2 | 2 | NC | NC |
| 680 | 1146 | ACTCACAGAATTGGCACTGC | 2 | 2 | NC | NC |
| 681 | 1148 | ATACTCACAGAATTGGCACT | 2 | 2 | NC | NC |
| 682 | 1149 | CATACTCACAGAATTGGCAC | 2 | 2 | NC | NC |
| 683 | 1150 | TCATACTCACAGAATTGGCA | 2 | 2 | NC | NC |
| 684 | 1151 | ATCATACTCACAGAATTGGC | 2 | 3 | NC | NC |
| 685 | 1152 | CATCATACTCACAGAATTGG | 2 | 2 | NC | NC |
| 686 | 1153 | ACATCATACTCACAGAATTG | 2 | 2 | NC | NC |
| 687 | 1154 | CACATCATACTCACAGAATT | 1 | 2 | NC | NC |
| 688 | 1155 | ACACATCATACTCACAGAAT | 2 | 2 | NC | NC |
| 689 | 1156 | CACACATCATACTCACAGAA | 1 | 2 | NC | NC |
| 690 | 1157 | GCACACATCATACTCACAGA | 2 | 2 | NC | NC |
| 691 | 1158 | TGCACACATCATACTCACAG | 2 | 1 | NC | NC |
| 692 | 1159 | ATGCACACATCATACTCACA | 1 | 2 | NC | NC |
| 693 | 1160 | CATGCACACATCATACTCAC | 2 | 2 | NC | NC |
| 694 | 1161 | CCATGCACACATCATACTCA | 2 | 2 | NC | NC |
| 695 | 1162 | TCCATGCACACATCATACTC | 1 | 2 | NC | NC |
| 696 | 1163 | CTCCATGCACACATCATACT | 1 | 1 | NC | NC |
| 697 | 1176 | GAGTTTTGGCTGGCTCCATG | 2 | 2 | NC | NC |
| 698 | 1177 | AGAGTTTTGGCTGGCTCCAT | 2 | 2 | NC | NC |
| 699 | 1178 | CAGAGTTTTGGCTGGCTCCA | 2 | 2 | NC | NC |
| 700 | 1179 | TCAGAGTTTTGGCTGGCTCC | 2 | 2 | NC | NC |
| 701 | 1180 | ATCAGAGTTTTGGCTGGCTC | 2 | 2 | 2 | 2 |
| 702 | 1181 | AATCAGAGTTTTGGCTGGCT | 2 | 2 | 2 | 2 |
| 703 | 1182 | CAATCAGAGTTTTGGCTGGC | 2 | 2 | 2 | 2 |
| 704 | 1183 | TCAATCAGAGTTTTGGCTGG | 2 | 2 | 2 | 2 |
| 705 | 1184 | TTCAATCAGAGTTTTGGCTG | 2 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 706 | 1185 | ATTCAATCAGAGTTTTGGCT | 2 | NC | NC | NC |
| 707 | 1186 | AATTCAATCAGAGTTTTGGC | 2 | NC | NC | NC |
| 708 | 1187 | AAATTCAATCAGAGTTTTGG | 2 | NC | NC | NC |
| 709 | 1188 | GAAATTCAATCAGAGTTTTG | 2 | NC | NC | NC |
| 710 | 1189 | TGAAATTCAATCAGAGTTTT | 1 | NC | NC | NC |
| 711 | 1196 | CCAGTTCTGAAATTCAATCA | 1 | NC | NC | NC |
| 712 | 1197 | CCCAGTTCTGAAATTCAATC | 2 | NC | NC | NC |
| 713 | 1198 | TCCCAGTTCTGAAATTCAAT | 2 | NC | NC | NC |
| 714 | 1199 | GTCCCAGTTCTGAAATTCAA | 2 | NC | NC | NC |
| 715 | 1200 | TGTCCCAGTTCTGAAATTCA | 2 | NC | NC | NC |
| 716 | 1201 | GTGTCCCAGTTCTGAAATTC | 1 | NC | NC | NC |
| 717 | 1202 | AGTGTCCCAGTTCTGAAATT | 1 | NC | NC | NC |
| 718 | 1203 | GAGTGTCCCAGTTCTGAAAT | 2 | NC | NC | NC |
| 719 | 1204 | AGAGTGTCCCAGTTCTGAAA | 2 | 2 | NC | NC |
| 720 | 1205 | GAGAGTGTCCCAGTTCTGAA | 2 | 2 | NC | NC |
| 721 | 1206 | AGAGAGTGTCCCAGTTCTGA | 2 | 2 | NC | NC |
| 722 | 1207 | AAGAGAGTGTCCCAGTTCTG | 2 | 2 | NC | NC |
| 723 | 1208 | CAAGAGAGTGTCCCAGTTCT | 1 | 2 | NC | NC |
| 724 | 1209 | ACAAGAGAGTGTCCCAGTTC | 2 | 2 | NC | NC |
| 725 | 1210 | AACAAGAGAGTGTCCCAGTT | 1 | 2 | NC | NC |
| 726 | 1211 | AAACAAGAGAGTGTCCCAGT | 2 | 2 | NC | NC |
| 727 | 1212 | AAAACAAGAGAGTGTCCCAG | 2 | 1 | NC | NC |
| 728 | 1213 | CAAAACAAGAGAGTGTCCCA | 2 | 1 | NC | NC |
| 729 | 1214 | GCAAAACAAGAGAGTGTCCC | 2 | NC | NC | NC |
| 730 | 1215 | TGCAAAACAAGAGAGTGTCC | 2 | NC | NC | NC |
| 731 | 1216 | ATGCAAAACAAGAGAGTGTC | 1 | NC | NC | NC |
| 732 | 1217 | AATGCAAAACAAGAGAGTGT | 2 | NC | NC | NC |
| 733 | 1218 | GAATGCAAAACAAGAGAGTG | 1 | NC | NC | NC |
| 734 | 1219 | TGAATGCAAAACAAGAGAGT | 1 | NC | NC | NC |
| 735 | 1220 | CTGAATGCAAAACAAGAGAG | 1 | NC | NC | NC |
| 736 | 1221 | CCTGAATGCAAAACAAGAGA | 2 | NC | NC | NC |
| 737 | 1222 | TCCTGAATGCAAAACAAGAG | 2 | NC | NC | NC |
| 738 | 1223 | TTCCTGAATGCAAAACAAGA | 1 | NC | NC | NC |
| 739 | 1224 | CTTCCTGAATGCAAAACAAG | 1 | NC | NC | NC |
| 740 | 1225 | CCTTCCTGAATGCAAAACAA | 2 | NC | NC | NC |
| 741 | 1226 | TCCTTCCTGAATGCAAAACA | 1 | NC | NC | NC |
| 742 | 1227 | CTCCTTCCTGAATGCAAAAC | 2 | NC | NC | NC |

TABLE 2-continued

| Exemplary Oligonucleotides | | | | | | |
|---|---|---|---|---|---|---|
| SEQ | | | Off-target Score | | | |
| ID NO | Position | Sequence | Human | Cyno | Mouse | Rat |
| 743 | 1228 | ACTCCTTCCTGAATGCAAAA | 2 | NC | NC | NC |
| 744 | 1229 | CACTCCTTCCTGAATGCAAA | 2 | NC | NC | NC |
| 745 | 1230 | TCACTCCTTCCTGAATGCAA | 1 | NC | NC | NC |
| 746 | 1231 | TTCACTCCTTCCTGAATGCA | 1 | NC | NC | NC |
| 747 | 1232 | TTTCACTCCTTCCTGAATGC | 1 | NC | NC | NC |
| 748 | 1233 | TTTTCACTCCTTCCTGAATG | 2 | NC | NC | NC |
| 749 | 1234 | ATTTTCACTCCTTCCTGAAT | 2 | 1 | NC | NC |
| 750 | 1235 | CATTTTCACTCCTTCCTGAA | 2 | 2 | NC | NC |
| 751 | 1236 | ACATTTTCACTCCTTCCTGA | 2 | 2 | NC | NC |
| 752 | 1237 | AACATTTTCACTCCTTCCTG | 2 | 2 | NC | NC |
| 753 | 1238 | AAACATTTTCACTCCTTCCT | 2 | 2 | NC | NC |
| 754 | 1239 | AAAACATTTTCACTCCTTCC | 1 | 1 | NC | NC |
| 755 | 1240 | AAAAACATTTTCACTCCTTC | 2 | 1 | NC | NC |
| 756 | 1241 | TAAAAACATTTTCACTCCTT | 1 | 0 | NC | NC |
| 757 | 1242 | TTAAAAACATTTTCACTCCT | 2 | 1 | NC | NC |
| 758 | 1243 | TTTAAAAACATTTTCACTCC | 2 | 2 | NC | NC |
| 759 | 1244 | CTTTAAAAACATTTTCACTC | 1 | 1 | NC | NC |
| 760 | 1245 | GCTTTAAAAACATTTTCACT | 1 | 1 | NC | NC |
| 761 | 1246 | TGCTTTAAAAACATTTTCAC | 0 | 1 | NC | NC |
| 762 | 1248 | CTTGCTTTAAAAACATTTTC | 1 | 1 | NC | NC |
| 763 | 1262 | CACAAATAATTTTTCTTGCT | 0 | 1 | NC | NC |
| 764 | 1263 | CCACAAATAATTTTTCTTGC | 1 | 2 | NC | NC |
| 765 | 1264 | TCCACAAATAATTTTTCTTG | 1 | 2 | NC | NC |
| 766 | 1272 | CTGATAATTCCACAAATAAT | 2 | 2 | NC | NC |
| 767 | 1273 | CCTGATAATTCCACAAATAA | 2 | 2 | NC | NC |
| 768 | 1274 | ACCTGATAATTCCACAAATA | 2 | 2 | NC | NC |
| 769 | 1275 | CACCTGATAATTCCACAAAT | 2 | 2 | NC | NC |
| 770 | 1276 | TCACCTGATAATTCCACAAA | 2 | 2 | NC | NC |
| 771 | 1277 | CTCACCTGATAATTCCACAA | 2 | 1 | NC | NC |
| 772 | 1278 | CCTCACCTGATAATTCCACA | 2 | 2 | NC | NC |
| 773 | 1279 | TCCTCACCTGATAATTCCAC | 2 | 2 | NC | NC |
| 774 | 1280 | ATCCTCACCTGATAATTCCA | 2 | 2 | NC | NC |
| 775 | 1281 | TATCCTCACCTGATAATTCC | 2 | 2 | NC | NC |
| 776 | 1282 | ATATCCTCACCTGATAATTC | 2 | 2 | NC | NC |
| 777 | 1283 | AATATCCTCACCTGATAATT | 2 | 2 | NC | NC |
| 778 | 1284 | TAATATCCTCACCTGATAAT | 2 | 2 | NC | NC |
| 779 | 1285 | TTAATATCCTCACCTGATAA | 2 | 2 | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 780 | 1286 | CTTAATATCCTCACCTGATA | 2 | 2 | NC | NC |
| 781 | 1287 | CCTTAATATCCTCACCTGAT | 2 | 2 | NC | NC |
| 782 | 1288 | TCCTTAATATCCTCACCTGA | 2 | 2 | NC | NC |
| 783 | 1289 | TTCCTTAATATCCTCACCTG | 2 | 2 | NC | NC |
| 784 | 1290 | ATTCCTTAATATCCTCACCT | 2 | 2 | NC | NC |
| 785 | 1291 | AATTCCTTAATATCCTCACC | 1 | 1 | NC | NC |
| 786 | 1292 | AAATTCCTTAATATCCTCAC | 2 | 2 | NC | NC |
| 787 | 1293 | TAAATTCCTTAATATCCTCA | 2 | 2 | NC | NC |
| 788 | 1294 | CTAAATTCCTTAATATCCTC | 2 | 2 | NC | NC |
| 789 | 1295 | ACTAAATTCCTTAATATCCT | 2 | 2 | NC | NC |
| 790 | 1296 | CACTAAATTCCTTAATATCC | 2 | 2 | NC | NC |
| 791 | 1297 | TCACTAAATTCCTTAATATC | 1 | 1 | NC | NC |
| 792 | 1299 | CTTCACTAAATTCCTTAATA | 1 | 1 | NC | NC |
| 793 | 1300 | TCTTCACTAAATTCCTTAAT | 2 | 1 | NC | NC |
| 794 | 1301 | ATCTTCACTAAATTCCTTAA | 2 | 2 | NC | NC |
| 795 | 1302 | TATCTTCACTAAATTCCTTA | 2 | 2 | NC | NC |
| 796 | 1303 | TTATCTTCACTAAATTCCTT | 1 | 1 | NC | NC |
| 797 | 1304 | ATTATCTTCACTAAATTCCT | 2 | 2 | NC | NC |
| 798 | 1305 | CATTATCTTCACTAAATTCC | 2 | 2 | NC | NC |
| 799 | 1306 | CCATTATCTTCACTAAATTC | 2 | 2 | NC | NC |
| 800 | 1307 | ACCATTATCTTCACTAAATT | 2 | 2 | NC | NC |
| 801 | 1308 | AACCATTATCTTCACTAAAT | 2 | 2 | NC | NC |
| 802 | 1309 | AAACCATTATCTTCACTAAA | 1 | 2 | NC | NC |
| 803 | 1310 | AAAACCATTATCTTCACTAA | 2 | 2 | NC | NC |
| 804 | 1311 | TAAAACCATTATCTTCACTA | 1 | 1 | NC | NC |
| 805 | 1312 | CTAAAACCATTATCTTCACT | 1 | NC | NC | NC |
| 806 | 1313 | ACTAAAACCATTATCTTCAC | 2 | NC | NC | NC |
| 807 | 1314 | AACTAAAACCATTATCTTCA | 2 | NC | NC | NC |
| 808 | 1315 | AAACTAAAACCATTATCTTC | 2 | NC | NC | NC |
| 809 | 1323 | CATCAAATAAACTAAAACCA | 2 | NC | NC | NC |
| 810 | 1324 | GCATCAAATAAACTAAAACC | 2 | NC | NC | NC |
| 811 | 1325 | AGCATCAAATAAACTAAAAC | 2 | NC | NC | NC |
| 812 | 1327 | GTAGCATCAAATAAACTAAA | 2 | NC | NC | NC |
| 813 | 1328 | AGTAGCATCAAATAAACTAA | 2 | NC | NC | NC |
| 814 | 1329 | GAGTAGCATCAAATAAACTA | 2 | NC | NC | NC |
| 815 | 1330 | AGAGTAGCATCAAATAAACT | 2 | NC | NC | NC |
| 816 | 1331 | AAGAGTAGCATCAAATAAAC | 1 | NC | NC | NC |

TABLE 2-continued

| Exemplary Oligonucleotides | | | | | | |
|---|---|---|---|---|---|---|
| SEQ | | | Off-target Score | | | |
| ID NO | Position | Sequence | Human | Cyno | Mouse | Rat |
| 817 | 1332 | GAAGAGTAGCATCAAATAAA | 1 | 2 | NC | NC |
| 818 | 1333 | TGAAGAGTAGCATCAAATAA | 2 | 2 | NC | NC |
| 819 | 1334 | CTGAAGAGTAGCATCAAATA | 2 | 2 | NC | NC |
| 820 | 1335 | TCTGAAGAGTAGCATCAAAT | 2 | 1 | NC | NC |
| 821 | 1336 | TTCTGAAGAGTAGCATCAAA | 2 | 2 | NC | NC |
| 822 | 1337 | CTTCTGAAGAGTAGCATCAA | 2 | 2 | NC | NC |
| 823 | 1342 | ACACGCTTCTGAAGAGTAGC | 2 | 2 | NC | NC |
| 824 | 1343 | CACACGCTTCTGAAGAGTAG | 2 | 2 | NC | NC |
| 825 | 1344 | TCACACGCTTCTGAAGAGTA | 2 | 2 | NC | NC |
| 826 | 1346 | AGTCACACGCTTCTGAAGAG | 3 | 2 | NC | NC |
| 827 | 1347 | AAGTCACACGCTTCTGAAGA | 2 | 2 | NC | NC |
| 828 | 1354 | TCATCGGAAGTCACACGCTT | 2 | 3 | NC | NC |
| 829 | 1355 | CTCATCGGAAGTCACACGCT | 2 | 2 | NC | NC |
| 830 | 1356 | TCTCATCGGAAGTCACACGC | 2 | 2 | NC | NC |
| 831 | 1357 | CTCTCATCGGAAGTCACACG | 2 | 2 | NC | NC |
| 832 | 1358 | CCTCTCATCGGAAGTCACAC | 2 | 2 | NC | NC |
| 833 | 1359 | TCCTCTCATCGGAAGTCACA | 2 | 2 | NC | NC |
| 834 | 1360 | CTCCTCTCATCGGAAGTCAC | 2 | 2 | NC | NC |
| 835 | 1361 | GCTCCTCTCATCGGAAGTCA | 3 | NC | NC | NC |
| 836 | 1362 | TGCTCCTCTCATCGGAAGTC | 2 | NC | NC | NC |
| 837 | 1363 | TTGCTCCTCTCATCGGAAGT | 3 | NC | NC | NC |
| 838 | 1364 | ATTGCTCCTCTCATCGGAAG | 2 | NC | NC | NC |
| 839 | 1365 | AATTGCTCCTCTCATCGGAA | 3 | NC | NC | NC |
| 840 | 1366 | AAATTGCTCCTCTCATCGGA | 3 | NC | NC | NC |
| 841 | 1367 | GAAATTGCTCCTCTCATCGG | 2 | NC | NC | NC |
| 842 | 1368 | GGAAATTGCTCCTCTCATCG | 2 | NC | NC | NC |
| 843 | 1369 | TGGAAATTGCTCCTCTCATC | 2 | NC | NC | NC |
| 844 | 1370 | CTGGAAATTGCTCCTCTCAT | 2 | NC | NC | NC |
| 845 | 1371 | CCTGGAAATTGCTCCTCTCA | 1 | NC | NC | NC |
| 846 | 1372 | TCCTGGAAATTGCTCCTCTC | 1 | NC | NC | NC |
| 847 | 1373 | TTCCTGGAAATTGCTCCTCT | 2 | NC | NC | NC |
| 848 | 1374 | CTTCCTGGAAATTGCTCCTC | 1 | NC | NC | NC |
| 849 | 1375 | GCTTCCTGGAAATTGCTCCT | 2 | NC | NC | NC |
| 850 | 1376 | TGCTTCCTGGAAATTGCTCC | 2 | NC | NC | NC |
| 851 | 1377 | ATGCTTCCTGGAAATTGCTC | 2 | NC | NC | NC |
| 852 | 1378 | CATGCTTCCTGGAAATTGCT | 1 | NC | NC | NC |
| 853 | 1379 | ACATGCTTCCTGGAAATTGC | 1 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 854 | 1380 | TACATGCTTCCTGGAAATTG | 1 | NC | NC | NC |
| 855 | 1381 | TTACATGCTTCCTGGAAATT | 2 | NC | NC | NC |
| 856 | 1382 | ATTACATGCTTCCTGGAAAT | 2 | NC | NC | NC |
| 857 | 1383 | TATTACATGCTTCCTGGAAA | 2 | 2 | NC | NC |
| 858 | 1384 | TTATTACATGCTTCCTGGAA | 2 | 2 | NC | NC |
| 859 | 1385 | ATTATTACATGCTTCCTGGA | 2 | 2 | NC | NC |
| 860 | 1386 | TATTATTACATGCTTCCTGG | 1 | 2 | NC | NC |
| 861 | 1387 | ATATTATTACATGCTTCCTG | 2 | 2 | NC | NC |
| 862 | 1388 | AATATTATTACATGCTTCCT | 2 | 2 | NC | NC |
| 863 | 1389 | AAATATTATTACATGCTTCC | 2 | 1 | NC | NC |
| 864 | 1403 | CTCATAGGAATCTAAAATAT | 2 | 2 | NC | NC |
| 865 | 1404 | TCTCATAGGAATCTAAAATA | 2 | 2 | NC | NC |
| 866 | 1405 | ATCTCATAGGAATCTAAAAT | 2 | 2 | NC | NC |
| 867 | 1406 | CATCTCATAGGAATCTAAAA | 2 | 2 | NC | NC |
| 868 | 1407 | ACATCTCATAGGAATCTAAA | 2 | 2 | NC | NC |
| 869 | 1408 | AACATCTCATAGGAATCTAA | 2 | 2 | NC | NC |
| 870 | 1409 | AAACATCTCATAGGAATCTA | 2 | 2 | NC | NC |
| 871 | 1410 | TAAACATCTCATAGGAATCT | 2 | 2 | NC | NC |
| 872 | 1411 | TTAAACATCTCATAGGAATC | 2 | 2 | NC | NC |
| 873 | 1412 | ATTAAACATCTCATAGGAAT | 2 | 2 | NC | NC |
| 874 | 1413 | AATTAAACATCTCATAGGAA | 1 | 1 | NC | NC |
| 875 | 1414 | AAATTAAACATCTCATAGGA | 1 | 2 | NC | NC |
| 876 | 1415 | CAAATTAAACATCTCATAGG | 2 | 2 | NC | NC |
| 877 | 1416 | GCAAATTAAACATCTCATAG | 1 | 2 | NC | NC |
| 878 | 1417 | TGCAAATTAAACATCTCATA | 1 | 1 | NC | NC |
| 879 | 1418 | CTGCAAATTAAACATCTCAT | 2 | NC | NC | NC |
| 880 | 1419 | ACTGCAAATTAAACATCTCA | 2 | NC | NC | NC |
| 881 | 1420 | GACTGCAAATTAAACATCTC | 2 | NC | NC | NC |
| 882 | 1421 | TGACTGCAAATTAAACATCT | 1 | NC | NC | NC |
| 883 | 1422 | TTGACTGCAAATTAAACATC | 2 | NC | NC | NC |
| 884 | 1423 | TTTGACTGCAAATTAAACAT | 2 | NC | NC | NC |
| 885 | 1436 | TCTTTTCACAGCTTTTGACT | 1 | NC | NC | NC |
| 886 | 1437 | TTCTTTTCACAGCTTTTGAC | 1 | NC | NC | NC |
| 887 | 1438 | TTTCTTTTCACAGCTTTTGA | 1 | NC | NC | NC |
| 888 | 1439 | TTTTCTTTTCACAGCTTTTG | 1 | NC | NC | NC |
| 889 | 1440 | TTTTTCTTTTCACAGCTTTT | 1 | NC | NC | NC |
| 890 | 1441 | GTTTTTCTTTTCACAGCTTT | 1 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 891 | 1442 | AGTTTTTCTTTTCACAGCTT | 1 | NC | NC | NC |
| 892 | 1443 | TAGTTTTTCTTTTCACAGCT | 1 | NC | NC | NC |
| 893 | 1444 | GTAGTTTTTCTTTTCACAGC | 0 | NC | NC | NC |
| 894 | 1445 | AGTAGTTTTTCTTTTCACAG | 1 | NC | NC | NC |
| 895 | 1446 | CAGTAGTTTTTCTTTTCACA | 2 | NC | NC | NC |
| 896 | 1447 | GCAGTAGTTTTTCTTTTCAC | 1 | NC | NC | NC |
| 897 | 1448 | TGCAGTAGTTTTTCTTTTCA | 1 | NC | NC | NC |
| 898 | 1449 | CTGCAGTAGTTTTTCTTTTC | 2 | NC | NC | NC |
| 899 | 1450 | TCTGCAGTAGTTTTTCTTTT | 1 | NC | NC | NC |
| 900 | 1451 | TTCTGCAGTAGTTTTTCTTT | 1 | NC | NC | NC |
| 901 | 1452 | TTTCTGCAGTAGTTTTTCTT | 1 | NC | NC | NC |
| 902 | 1453 | TTTTCTGCAGTAGTTTTTCT | 1 | NC | NC | NC |
| 903 | 1454 | GTTTTCTGCAGTAGTTTTTC | 2 | NC | NC | NC |
| 904 | 1455 | CGTTTTCTGCAGTAGTTTTT | 2 | NC | NC | NC |
| 905 | 1456 | ACGTTTTCTGCAGTAGTTTT | 2 | NC | NC | NC |
| 906 | 1457 | TACGTTTTCTGCAGTAGTTT | 2 | NC | NC | NC |
| 907 | 1458 | TTACGTTTTCTGCAGTAGTT | 2 | NC | NC | NC |
| 908 | 1459 | TTTACGTTTTCTGCAGTAGT | 2 | NC | NC | NC |
| 909 | 1460 | GTTTACGTTTTCTGCAGTAG | 3 | NC | NC | NC |
| 910 | 1461 | TGTTTACGTTTTCTGCAGTA | 2 | NC | NC | NC |
| 911 | 1462 | GTGTTTACGTTTTCTGCAGT | 3 | NC | NC | NC |
| 912 | 1463 | TGTGTTTACGTTTTCTGCAG | 2 | NC | NC | NC |
| 913 | 1464 | GTGTGTTTACGTTTTCTGCA | 2 | NC | NC | NC |
| 914 | 1465 | TGTGTGTTTACGTTTTCTGC | 2 | NC | NC | NC |
| 915 | 1466 | CTGTGTGTTTACGTTTTCTG | 2 | NC | NC | NC |
| 916 | 1467 | TCTGTGTGTTTACGTTTTCT | 1 | NC | NC | NC |
| 917 | 1468 | CTCTGTGTGTTTACGTTTTC | 1 | NC | NC | NC |
| 918 | 1469 | ACTCTGTGTGTTTACGTTTT | 2 | NC | NC | NC |
| 919 | 1470 | AACTCTGTGTGTTTACGTTT | 2 | NC | NC | NC |
| 920 | 1471 | GAACTCTGTGTGTTTACGTT | 1 | NC | NC | NC |
| 921 | 1472 | AGAACTCTGTGTGTTTACGT | 2 | NC | NC | NC |
| 922 | 1473 | TAGAACTCTGTGTGTTTACG | 3 | NC | NC | NC |
| 923 | 1474 | CTAGAACTCTGTGTGTTTAC | 2 | NC | NC | NC |
| 924 | 1475 | CCTAGAACTCTGTGTGTTTA | 2 | NC | NC | NC |
| 925 | 1476 | CCCTAGAACTCTGTGTGTTT | 2 | NC | NC | NC |
| 926 | 1477 | TCCCTAGAACTCTGTGTGTT | 2 | NC | NC | NC |
| 927 | 1478 | ATCCCTAGAACTCTGTGTGT | 2 | NC | NC | NC |

TABLE 2-continued

| Exemplary Oligonucleotides | | | | | | |
|---|---|---|---|---|---|---|
| SEQ | | | Off-target Score | | | |
| ID NO | Position | Sequence | Human | Cyno | Mouse | Rat |
| 928 | 1479 | AATCCCTAGAACTCTGTGTG | 2 | NC | NC | NC |
| 929 | 1480 | GAATCCCTAGAACTCTGTGT | 2 | NC | NC | NC |
| 930 | 1481 | TGAATCCCTAGAACTCTGTG | 2 | NC | NC | NC |
| 931 | 1482 | CTGAATCCCTAGAACTCTGT | 2 | NC | NC | NC |
| 932 | 1483 | TCTGAATCCCTAGAACTCTG | 2 | NC | NC | NC |
| 933 | 1484 | TTCTGAATCCCTAGAACTCT | 2 | NC | NC | NC |
| 934 | 1485 | CTTCTGAATCCCTAGAACTC | 2 | NC | NC | NC |
| 935 | 1486 | GCTTCTGAATCCCTAGAACT | 2 | NC | NC | NC |
| 936 | 1487 | AGCTTCTGAATCCCTAGAAC | 2 | NC | NC | NC |
| 937 | 1488 | TAGCTTCTGAATCCCTAGAA | 2 | NC | NC | NC |
| 938 | 1489 | GTAGCTTCTGAATCCCTAGA | 2 | NC | NC | NC |
| 939 | 1490 | GGTAGCTTCTGAATCCCTAG | 2 | NC | NC | NC |
| 940 | 1491 | TGGTAGCTTCTGAATCCCTA | 2 | NC | NC | NC |
| 941 | 1492 | CTGGTAGCTTCTGAATCCCT | 2 | NC | NC | NC |
| 942 | 1493 | TCTGGTAGCTTCTGAATCCC | 2 | NC | NC | NC |
| 943 | 1494 | TTCTGGTAGCTTCTGAATCC | 2 | NC | NC | NC |
| 944 | 1495 | TTTCTGGTAGCTTCTGAATC | 2 | NC | NC | NC |
| 945 | 1496 | TTTTCTGGTAGCTTCTGAAT | 2 | NC | NC | NC |
| 946 | 1497 | TTTTTCTGGTAGCTTCTGAA | 2 | NC | NC | NC |
| 947 | 1522 | ATGTACAAAAATGCATCATT | 1 | NC | NC | NC |
| 948 | 1523 | AATGTACAAAAATGCATCAT | 1 | NC | NC | NC |
| 949 | 1524 | AAATGTACAAAAATGCATCA | 1 | NC | NC | NC |
| 950 | 1525 | TAAATGTACAAAAATGCATC | 1 | NC | NC | NC |
| 951 | 1527 | CATAAATGTACAAAAATGCA | 1 | NC | NC | NC |
| 952 | 1528 | TCATAAATGTACAAAAATGC | 1 | NC | NC | NC |
| 953 | 1533 | CTGATTCATAAATGTACAAA | 2 | NC | NC | NC |
| 954 | 1534 | CCTGATTCATAAATGTACAA | 2 | NC | NC | NC |
| 955 | 1535 | ACCTGATTCATAAATGTACA | 2 | NC | NC | NC |
| 956 | 1536 | CACCTGATTCATAAATGTAC | 2 | NC | NC | NC |
| 957 | 1537 | CCACCTGATTCATAAATGTA | 2 | NC | NC | NC |
| 958 | 1538 | ACCACCTGATTCATAAATGT | 2 | NC | NC | NC |
| 959 | 1539 | GACCACCTGATTCATAAATG | 2 | 2 | NC | NC |
| 960 | 1540 | GGACCACCTGATTCATAAAT | 2 | 2 | NC | NC |
| 961 | 1542 | CTGGACCACCTGATTCATAA | 2 | 2 | NC | NC |
| 962 | 1543 | CCTGGACCACCTGATTCATA | 1 | 1 | NC | NC |
| 963 | 1544 | GCCTGGACCACCTGATTCAT | 1 | 1 | NC | NC |
| 964 | 1563 | GCTCTGTCATTTTGCTATGG | 2 | 2 | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 965 | 1564 | GGCTCTGTCATTTTGCTATG | 2 | 2 | NC | NC |
| 966 | 1565 | TGGCTCTGTCATTTTGCTAT | 1 | 2 | NC | NC |
| 967 | 1566 | ATGGCTCTGTCATTTTGCTA | 2 | 2 | NC | NC |
| 968 | 1567 | GATGGCTCTGTCATTTTGCT | 2 | 2 | NC | NC |
| 969 | 1568 | AGATGGCTCTGTCATTTTGC | 1 | 2 | NC | NC |
| 970 | 1569 | AAGATGGCTCTGTCATTTTG | 2 | 2 | NC | NC |
| 971 | 1570 | AAAGATGGCTCTGTCATTTT | 2 | 2 | NC | NC |
| 972 | 1571 | TAAAGATGGCTCTGTCATTT | 2 | 2 | NC | NC |
| 973 | 1572 | GTAAAGATGGCTCTGTCATT | 2 | 2 | NC | NC |
| 974 | 1573 | TGTAAAGATGGCTCTGTCAT | 2 | 2 | NC | NC |
| 975 | 1574 | TTGTAAAGATGGCTCTGTCA | 2 | 2 | NC | NC |
| 976 | 1575 | TTTGTAAAGATGGCTCTGTC | 2 | 2 | NC | NC |
| 977 | 1576 | TTTTGTAAAGATGGCTCTGT | 2 | 2 | NC | NC |
| 978 | 1577 | GTTTTGTAAAGATGGCTCTG | 1 | 2 | NC | NC |
| 979 | 1578 | TGTTTTGTAAAGATGGCTCT | 1 | 2 | NC | NC |
| 980 | 1579 | TTGTTTTGTAAAGATGGCTC | 2 | 2 | NC | NC |
| 981 | 1580 | TTTGTTTTGTAAAGATGGCT | 2 | 2 | NC | NC |
| 982 | 1581 | CTTTGTTTTGTAAAGATGGC | 1 | 2 | NC | NC |
| 983 | 1582 | TCTTTGTTTTGTAAAGATGG | 1 | 1 | NC | NC |
| 984 | 1586 | GCTGTCTTTGTTTTGTAAAG | 2 | 1 | NC | NC |
| 985 | 1587 | AGCTGTCTTTGTTTTGTAAA | 2 | 1 | NC | NC |
| 986 | 1588 | GAGCTGTCTTTGTTTTGTAA | 2 | 2 | NC | NC |
| 987 | 1589 | AGAGCTGTCTTTGTTTTGTA | 2 | 2 | NC | NC |
| 988 | 1590 | AAGAGCTGTCTTTGTTTTGT | 1 | 1 | NC | NC |
| 989 | 1604 | CTTTGATTCTGAGCAAGAGC | 2 | NC | NC | NC |
| 990 | 1605 | TCTTTGATTCTGAGCAAGAG | 2 | NC | NC | NC |
| 991 | 1606 | ATCTTTGATTCTGAGCAAGA | 2 | NC | NC | NC |
| 992 | 1607 | CATCTTTGATTCTGAGCAAG | 2 | NC | NC | NC |
| 993 | 1608 | ACATCTTTGATTCTGAGCAA | 2 | NC | NC | NC |
| 994 | 1609 | AACATCTTTGATTCTGAGCA | 2 | NC | NC | NC |
| 995 | 1610 | TAACATCTTTGATTCTGAGC | 2 | NC | NC | NC |
| 996 | 1611 | CTAACATCTTTGATTCTGAG | 2 | NC | NC | NC |
| 997 | 1612 | TCTAACATCTTTGATTCTGA | 2 | NC | NC | NC |
| 998 | 1613 | TTCTAACATCTTTGATTCTG | 2 | NC | NC | NC |
| 999 | 1614 | GTTCTAACATCTTTGATTCT | 2 | NC | NC | NC |
| 1000 | 1615 | TGTTCTAACATCTTTGATTC | 2 | NC | NC | NC |
| 1001 | 1625 | AATTGTCTCTTGTTCTAACA | 1 | 1 | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 1002 | 1626 | CAATTGTCTCTTGTTCTAAC | 2 | 2 | NC | NC |
| 1003 | 1627 | ACAATTGTCTCTTGTTCTAA | 2 | 1 | NC | NC |
| 1004 | 1628 | TACAATTGTCTCTTGTTCTA | 2 | 2 | NC | NC |
| 1005 | 1629 | CTACAATTGTCTCTTGTTCT | 2 | 2 | NC | NC |
| 1006 | 1630 | GCTACAATTGTCTCTTGTTC | 2 | 2 | NC | NC |
| 1007 | 1631 | TGCTACAATTGTCTCTTGTT | 2 | 2 | NC | NC |
| 1008 | 1633 | GATGCTACAATTGTCTCTTG | 2 | 2 | NC | NC |
| 1009 | 1634 | TGATGCTACAATTGTCTCTT | 2 | 2 | NC | NC |
| 1010 | 1635 | CTGATGCTACAATTGTCTCT | 2 | 2 | NC | NC |
| 1011 | 1636 | TCTGATGCTACAATTGTCTC | 2 | 1 | NC | NC |
| 1012 | 1637 | TTCTGATGCTACAATTGTCT | 2 | 1 | NC | NC |
| 1013 | 1638 | CTTCTGATGCTACAATTGTC | 2 | 2 | NC | NC |
| 1014 | 1639 | GCTTCTGATGCTACAATTGT | 2 | 2 | NC | NC |
| 1015 | 1641 | CAGCTTCTGATGCTACAATT | 2 | NC | NC | NC |
| 1016 | 1642 | CCAGCTTCTGATGCTACAAT | 2 | NC | NC | NC |
| 1017 | 1643 | TCCAGCTTCTGATGCTACAA | 2 | NC | NC | NC |
| 1018 | 1644 | CTCCAGCTTCTGATGCTACA | 2 | NC | NC | NC |
| 1019 | 1645 | TCTCCAGCTTCTGATGCTAC | 2 | NC | NC | NC |
| 1020 | 1646 | TTCTCCAGCTTCTGATGCTA | 2 | NC | NC | NC |
| 1021 | 1648 | TTTTCTCCAGCTTCTGATGC | 2 | NC | NC | NC |
| 1022 | 1649 | ATTTTCTCCAGCTTCTGATG | 2 | NC | NC | NC |
| 1023 | 1650 | CATTTTCTCCAGCTTCTGAT | 2 | NC | NC | NC |
| 1024 | 1651 | TCATTTTCTCCAGCTTCTGA | 1 | NC | NC | NC |
| 1025 | 1652 | CTCATTTTCTCCAGCTTCTG | 1 | NC | NC | NC |
| 1026 | 1653 | TCTCATTTTCTCCAGCTTCT | 2 | NC | NC | NC |
| 1027 | 1654 | TTCTCATTTTCTCCAGCTTC | 1 | NC | NC | NC |
| 1028 | 1655 | TTTCTCATTTTCTCCAGCTT | 1 | NC | NC | NC |
| 1029 | 1656 | GTTTCTCATTTTCTCCAGCT | 2 | NC | NC | NC |
| 1030 | 1657 | TGTTTCTCATTTTCTCCAGC | 2 | NC | NC | NC |
| 1031 | 1658 | ATGTTTCTCATTTTCTCCAG | 1 | NC | NC | NC |
| 1032 | 1659 | TATGTTTCTCATTTTCTCCA | 1 | NC | NC | NC |
| 1033 | 1660 | TTATGTTTCTCATTTTCTCC | 1 | 1 | NC | NC |
| 1034 | 1661 | TTTATGTTTCTCATTTTCTC | 1 | 1 | NC | NC |
| 1035 | 1679 | ATGTTCCAGGAAAGATTTTT | 1 | NC | NC | NC |
| 1036 | 1680 | TATGTTCCAGGAAAGATTTT | 2 | NC | NC | NC |
| 1037 | 1681 | CTATGTTCCAGGAAAGATTT | 2 | NC | NC | NC |
| 1038 | 1682 | GCTATGTTCCAGGAAAGATT | 1 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 1039 | 1683 | AGCTATGTTCCAGGAAAGAT | 2 | NC | NC | NC |
| 1040 | 1684 | GAGCTATGTTCCAGGAAAGA | 1 | NC | NC | NC |
| 1041 | 1685 | AGAGCTATGTTCCAGGAAAG | 2 | NC | NC | NC |
| 1042 | 1686 | AAGAGCTATGTTCCAGGAAA | 2 | NC | NC | NC |
| 1043 | 1687 | AAAGAGCTATGTTCCAGGAA | 2 | NC | NC | NC |
| 1044 | 1688 | TAAAGAGCTATGTTCCAGGA | 2 | NC | NC | NC |
| 1045 | 1689 | CTAAAGAGCTATGTTCCAGG | 2 | 2 | NC | NC |
| 1046 | 1690 | TCTAAAGAGCTATGTTCCAG | 1 | 2 | NC | NC |
| 1047 | 1691 | TTCTAAAGAGCTATGTTCCA | 2 | 2 | NC | NC |
| 1048 | 1692 | TTTCTAAAGAGCTATGTTCC | 2 | 2 | NC | NC |
| 1049 | 1693 | TTTTCTAAAGAGCTATGTTC | 1 | 1 | NC | NC |
| 1050 | 1694 | ATTTTCTAAAGAGCTATGTT | 1 | NC | NC | NC |
| 1051 | 1695 | GATTTTCTAAAGAGCTATGT | 2 | NC | NC | NC |
| 1052 | 1696 | GGATTTTCTAAAGAGCTATG | 2 | NC | NC | NC |
| 1053 | 1697 | CGGATTTTCTAAAGAGCTAT | 2 | NC | NC | NC |
| 1054 | 1698 | ACGGATTTTCTAAAGAGCTA | 2 | NC | NC | NC |
| 1055 | 1699 | CACGGATTTTCTAAAGAGCT | 2 | NC | NC | NC |
| 1056 | 1700 | ACACGGATTTTCTAAAGAGC | 2 | NC | NC | NC |
| 1057 | 1701 | CACACGGATTTTCTAAAGAG | 2 | NC | NC | NC |
| 1058 | 1702 | CCACACGGATTTTCTAAAGA | 2 | NC | NC | NC |
| 1059 | 1703 | TCCACACGGATTTTCTAAAG | 2 | NC | NC | NC |
| 1060 | 1714 | TCTAAACTGGTTCCACACGG | 2 | NC | NC | NC |
| 1061 | 1715 | TTCTAAACTGGTTCCACACG | 1 | NC | NC | NC |
| 1062 | 1716 | TTTCTAAACTGGTTCCACAC | 1 | NC | NC | NC |
| 1063 | 1717 | ATTTCTAAACTGGTTCCACA | 2 | NC | NC | NC |
| 1064 | 1718 | CATTTCTAAACTGGTTCCAC | 2 | NC | NC | NC |
| 1065 | 1719 | ACATTTCTAAACTGGTTCCA | 2 | NC | NC | NC |
| 1066 | 1720 | AACATTTCTAAACTGGTTCC | 1 | NC | NC | NC |
| 1067 | 1721 | AAACATTTCTAAACTGGTTC | 2 | NC | NC | NC |
| 1068 | 1722 | AAAACATTTCTAAACTGGTT | 1 | NC | NC | NC |
| 1069 | 1723 | AAAAACATTTCTAAACTGGT | 1 | NC | NC | NC |
| 1070 | 1724 | TAAAAACATTTCTAAACTGG | 1 | NC | NC | NC |
| 1071 | 1727 | GCTTAAAAACATTTCTAAAC | 2 | NC | NC | NC |
| 1072 | 1728 | GGCTTAAAAACATTTCTAAA | 2 | NC | NC | NC |
| 1073 | 1729 | GGGCTTAAAAACATTTCTAA | 2 | NC | NC | NC |
| 1074 | 1730 | AGGGCTTAAAAACATTTCTA | 1 | NC | NC | NC |
| 1075 | 1731 | AAGGGCTTAAAAACATTTCT | 1 | 2 | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 1076 | 1732 | AAAGGGCTTAAAAACATTTC | 1 | 1 | NC | NC |
| 1077 | 1733 | AAAAGGGCTTAAAAACATTT | 1 | 1 | NC | NC |
| 1078 | 1734 | GAAAAGGGCTTAAAAACATT | 1 | 2 | NC | NC |
| 1079 | 1735 | TGAAAAGGGCTTAAAAACAT | 1 | 1 | NC | NC |
| 1080 | 1736 | CTGAAAAGGGCTTAAAAACA | 2 | 1 | NC | NC |
| 1081 | 1737 | TCTGAAAAGGGCTTAAAAAC | 1 | 1 | NC | NC |
| 1082 | 1738 | GTCTGAAAAGGGCTTAAAAA | 2 | 2 | NC | NC |
| 1083 | 1739 | TGTCTGAAAAGGGCTTAAAA | 1 | 1 | NC | NC |
| 1084 | 1740 | GTGTCTGAAAAGGGCTTAAA | 2 | 2 | NC | NC |
| 1085 | 1741 | GGTGTCTGAAAAGGGCTTAA | 2 | 2 | NC | NC |
| 1086 | 1742 | TGGTGTCTGAAAAGGGCTTA | 2 | 2 | NC | NC |
| 1087 | 1743 | ATGGTGTCTGAAAAGGGCTT | 1 | 1 | NC | NC |
| 1088 | 1744 | CATGGTGTCTGAAAAGGGCT | 2 | 2 | NC | NC |
| 1089 | 1745 | ACATGGTGTCTGAAAAGGGC | 2 | 2 | NC | NC |
| 1090 | 1756 | TCCTCAAAGTGACATGGTGT | 1 | NC | NC | NC |
| 1091 | 1757 | CTCCTCAAAGTGACATGGTG | 2 | NC | NC | NC |
| 1092 | 1758 | TCTCCTCAAAGTGACATGGT | 2 | NC | NC | NC |
| 1093 | 1759 | CTCTCCTCAAAGTGACATGG | 3 | NC | NC | NC |
| 1094 | 1760 | ACTCTCCTCAAAGTGACATG | 2 | NC | NC | NC |
| 1095 | 1766 | CTGCCCACTCTCCTCAAAGT | 1 | NC | NC | NC |
| 1096 | 1768 | TCCTGCCCACTCTCCTCAAA | 2 | NC | NC | NC |
| 1097 | 1769 | ATCCTGCCCACTCTCCTCAA | 2 | NC | NC | NC |
| 1098 | 1772 | TAGATCCTGCCCACTCTCCT | 2 | NC | NC | NC |
| 1099 | 1774 | TCTAGATCCTGCCCACTCTC | 2 | NC | NC | NC |
| 1100 | 1775 | TTCTAGATCCTGCCCACTCT | 2 | NC | NC | NC |
| 1101 | 1776 | TTTCTAGATCCTGCCCACTC | 2 | NC | NC | NC |
| 1102 | 1777 | ATTTCTAGATCCTGCCCACT | 2 | NC | NC | NC |
| 1103 | 1778 | TATTTCTAGATCCTGCCCAC | 2 | NC | NC | NC |
| 1104 | 1779 | ATATTTCTAGATCCTGCCCA | 2 | NC | NC | NC |
| 1105 | 1780 | CATATTTCTAGATCCTGCCC | 2 | NC | NC | NC |
| 1106 | 1781 | CCATATTTCTAGATCCTGCC | 2 | NC | NC | NC |
| 1107 | 1782 | TCCATATTTCTAGATCCTGC | 2 | NC | NC | NC |
| 1108 | 1783 | TTCCATATTTCTAGATCCTG | 2 | NC | NC | NC |
| 1109 | 1784 | TTTCCATATTTCTAGATCCT | 1 | 1 | NC | NC |
| 1110 | 1785 | CTTTCCATATTTCTAGATCC | 2 | 2 | NC | NC |
| 1111 | 1786 | TCTTTCCATATTTCTAGATC | 2 | 2 | NC | NC |
| 1112 | 1787 | TTCTTTCCATATTTCTAGAT | 1 | 2 | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 1113 | 1788 | TTTCTTTCCATATTTCTAGA | 1 | 1 | NC | NC |
| 1114 | 1789 | CTTTCTTTCCATATTTCTAG | 1 | 1 | NC | NC |
| 1115 | 1790 | ACTTTCTTTCCATATTTCTA | 2 | 2 | NC | NC |
| 1116 | 1791 | TACTTTCTTTCCATATTTCT | 1 | 2 | NC | NC |
| 1117 | 1792 | GTACTTTCTTTCCATATTTC | 2 | 2 | NC | NC |
| 1118 | 1793 | AGTACTTTCTTTCCATATTT | 2 | 1 | NC | NC |
| 1119 | 1794 | TAGTACTTTCTTTCCATATT | 1 | 2 | NC | NC |
| 1120 | 1795 | GTAGTACTTTCTTTCCATAT | 1 | 2 | NC | NC |
| 1121 | 1796 | AGTAGTACTTTCTTTCCATA | 2 | 2 | NC | NC |
| 1122 | 1797 | CAGTAGTACTTTCTTTCCAT | 1 | 2 | NC | NC |
| 1123 | 1798 | ACAGTAGTACTTTCTTTCCA | 1 | 2 | NC | NC |
| 1124 | 1799 | AACAGTAGTACTTTCTTTCC | 1 | 2 | NC | NC |
| 1125 | 1800 | TAACAGTAGTACTTTCTTTC | 2 | 2 | NC | NC |
| 1126 | 1801 | TTAACAGTAGTACTTTCTTT | 2 | 2 | NC | NC |
| 1127 | 1802 | ATTAACAGTAGTACTTTCTT | 2 | 2 | NC | NC |
| 1128 | 1803 | CATTAACAGTAGTACTTTCT | 2 | 2 | NC | NC |
| 1129 | 1804 | CCATTAACAGTAGTACTTTC | 2 | NC | NC | NC |
| 1130 | 1805 | GCCATTAACAGTAGTACTTT | 2 | NC | NC | NC |
| 1131 | 1806 | TGCCATTAACAGTAGTACTT | 2 | NC | NC | NC |
| 1132 | 1807 | ATGCCATTAACAGTAGTACT | 2 | NC | NC | NC |
| 1133 | 1808 | CATGCCATTAACAGTAGTAC | 1 | NC | NC | NC |
| 1134 | 1809 | CCATGCCATTAACAGTAGTA | 2 | NC | NC | NC |
| 1135 | 1810 | GCCATGCCATTAACAGTAGT | 2 | NC | NC | NC |
| 1136 | 1811 | AGCCATGCCATTAACAGTAG | 2 | NC | NC | NC |
| 1137 | 1812 | CAGCCATGCCATTAACAGTA | 2 | NC | NC | NC |
| 1138 | 1824 | TCAAGATGTTGGCAGCCATG | 1 | NC | NC | NC |
| 1139 | 1825 | TTCAAGATGTTGGCAGCCAT | 2 | NC | NC | NC |
| 1140 | 1826 | TTTCAAGATGTTGGCAGCCA | 2 | NC | NC | NC |
| 1141 | 1827 | TTTTCAAGATGTTGGCAGCC | 2 | NC | NC | NC |
| 1142 | 1828 | TTTTTCAAGATGTTGGCAGC | 1 | NC | NC | NC |
| 1143 | 1829 | ATTTTTCAAGATGTTGGCAG | 1 | NC | NC | NC |
| 1144 | 1830 | TATTTTTCAAGATGTTGGCA | 2 | NC | NC | NC |
| 1145 | 1831 | TTATTTTTCAAGATGTTGGC | 2 | NC | NC | NC |
| 1146 | 1832 | ATTATTTTTCAAGATGTTGG | 2 | NC | NC | NC |
| 1147 | 1848 | GTTGATTCTGAATTCTATTA | 2 | 2 | NC | NC |
| 1148 | 1849 | GGTTGATTCTGAATTCTATT | 2 | 2 | NC | NC |
| 1149 | 1850 | TGGTTGATTCTGAATTCTAT | 2 | 2 | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 1150 | 1851 | TTGGTTGATTCTGAATTCTA | 2 | NC | NC | NC |
| 1151 | 1852 | TTTGGTTGATTCTGAATTCT | 2 | NC | NC | NC |
| 1152 | 1853 | CTTTGGTTGATTCTGAATTC | 2 | NC | NC | NC |
| 1153 | 1854 | TCTTTGGTTGATTCTGAATT | 2 | NC | NC | NC |
| 1154 | 1855 | CTCTTTGGTTGATTCTGAAT | 2 | NC | NC | NC |
| 1155 | 1856 | TCTCTTTGGTTGATTCTGAA | 2 | NC | NC | NC |
| 1156 | 1857 | ATCTCTTTGGTTGATTCTGA | 2 | NC | NC | NC |
| 1157 | 1858 | AATCTCTTTGGTTGATTCTG | 2 | NC | NC | NC |
| 1158 | 1859 | AAATCTCTTTGGTTGATTCT | 2 | NC | NC | NC |
| 1159 | 1860 | TAAATCTCTTTGGTTGATTC | 2 | NC | NC | NC |
| 1160 | 1861 | TTAAATCTCTTTGGTTGATT | 2 | NC | NC | NC |
| 1161 | 1862 | TTTAAATCTCTTTGGTTGAT | 2 | NC | NC | NC |
| 1162 | 1863 | CTTTAAATCTCTTTGGTTGA | 2 | NC | NC | NC |
| 1163 | 1864 | TCTTTAAATCTCTTTGGTTG | 2 | NC | NC | NC |
| 1164 | 1865 | ATCTTTAAATCTCTTTGGTT | 2 | NC | NC | NC |
| 1165 | 1866 | CATCTTTAAATCTCTTTGGT | 2 | NC | NC | NC |
| 1166 | 1867 | GCATCTTTAAATCTCTTTGG | 2 | NC | NC | NC |
| 1167 | 1868 | AGCATCTTTAAATCTCTTTG | 2 | NC | NC | NC |
| 1168 | 1869 | TAGCATCTTTAAATCTCTTT | 1 | NC | NC | NC |
| 1169 | 1870 | GTAGCATCTTTAAATCTCTT | 2 | NC | NC | NC |
| 1170 | 1871 | AGTAGCATCTTTAAATCTCT | 1 | 1 | NC | NC |
| 1171 | 1872 | CAGTAGCATCTTTAAATCTC | 1 | 1 | NC | NC |
| 1172 | 1873 | TCAGTAGCATCTTTAAATCT | 2 | 1 | NC | NC |
| 1173 | 1874 | TTCAGTAGCATCTTTAAATC | 1 | 1 | NC | NC |
| 1174 | 1875 | CTTCAGTAGCATCTTTAAAT | 1 | 1 | NC | NC |
| 1175 | 1876 | ACTTCAGTAGCATCTTTAAA | 2 | 2 | NC | NC |
| 1176 | 1877 | CACTTCAGTAGCATCTTTAA | 2 | 1 | NC | NC |
| 1177 | 1878 | CCACTTCAGTAGCATCTTTA | 2 | 2 | NC | NC |
| 1178 | 1879 | CCCACTTCAGTAGCATCTTT | 2 | 2 | NC | NC |
| 1179 | 1880 | TCCCACTTCAGTAGCATCTT | 2 | 2 | NC | NC |
| 1180 | 1881 | ATCCCACTTCAGTAGCATCT | 2 | 2 | NC | NC |
| 1181 | 1882 | CATCCCACTTCAGTAGCATC | 2 | 2 | NC | NC |
| 1182 | 1883 | GCATCCCACTTCAGTAGCAT | 2 | 2 | NC | NC |
| 1183 | 1884 | GGCATCCCACTTCAGTAGCA | 2 | 2 | NC | NC |
| 1184 | 1885 | TGGCATCCCACTTCAGTAGC | 2 | 2 | NC | NC |
| 1185 | 1886 | CTGGCATCCCACTTCAGTAG | 2 | 2 | NC | NC |
| 1186 | 1887 | GCTGGCATCCCACTTCAGTA | 2 | 2 | NC | NC |

TABLE 2-continued

| Exemplary Oligonucleotides | | | | | | |
|---|---|---|---|---|---|---|
| SEQ | | | Off-target Score | | | |
| ID NO | Position | Sequence | Human | Cyno | Mouse | Rat |
| 1187 | 1912 | CATAATGTTGTTGCAAAAGG | 2 | NC | NC | NC |
| 1188 | 1913 | CCATAATGTTGTTGCAAAAG | 2 | NC | NC | NC |
| 1189 | 1914 | CCCATAATGTTGTTGCAAAA | 2 | NC | NC | NC |
| 1190 | 1915 | CCCCATAATGTTGTTGCAAA | 2 | NC | NC | NC |
| 1191 | 1916 | TCCCCATAATGTTGTTGCAA | 1 | NC | NC | NC |
| 1192 | 1917 | CTCCCCATAATGTTGTTGCA | 2 | NC | NC | NC |
| 1193 | 1918 | ACTCCCCATAATGTTGTTGC | 1 | NC | NC | NC |
| 1194 | 1919 | TACTCCCCATAATGTTGTTG | 2 | NC | NC | NC |
| 1195 | 1920 | GTACTCCCCATAATGTTGTT | 2 | NC | NC | NC |
| 1196 | 1921 | TGTACTCCCCATAATGTTGT | 2 | NC | NC | NC |
| 1197 | 1922 | ATGTACTCCCCATAATGTTG | 2 | NC | NC | NC |
| 1198 | 1923 | TATGTACTCCCCATAATGTT | 2 | NC | NC | NC |
| 1199 | 1924 | CTATGTACTCCCCATAATGT | 2 | NC | NC | NC |
| 1200 | 1925 | ACTATGTACTCCCCATAATG | 2 | NC | NC | NC |
| 1201 | 1926 | CACTATGTACTCCCCATAAT | 2 | NC | NC | NC |
| 1202 | 1927 | GCACTATGTACTCCCCATAA | 2 | NC | NC | NC |
| 1203 | 1928 | AGCACTATGTACTCCCCATA | 2 | NC | NC | NC |
| 1204 | 1929 | GAGCACTATGTACTCCCCAT | 3 | NC | NC | NC |
| 1205 | 1930 | TGAGCACTATGTACTCCCCA | 1 | NC | NC | NC |
| 1206 | 1931 | CTGAGCACTATGTACTCCCC | 3 | NC | NC | NC |
| 1207 | 1932 | TCTGAGCACTATGTACTCCC | 2 | NC | NC | NC |
| 1208 | 1933 | GTCTGAGCACTATGTACTCC | 3 | NC | NC | NC |
| 1209 | 1934 | TGTCTGAGCACTATGTACTC | 3 | NC | NC | NC |
| 1210 | 1935 | CTGTCTGAGCACTATGTACT | 2 | NC | NC | NC |
| 1211 | 1936 | TCTGTCTGAGCACTATGTAC | 2 | NC | NC | NC |
| 1212 | 1937 | CTCTGTCTGAGCACTATGTA | 2 | NC | NC | NC |
| 1213 | 1947 | TTTTCTCTTTCTCTGTCTGA | 1 | NC | NC | NC |
| 1214 | 1948 | TTTTTCTCTTTCTCTGTCTG | 1 | NC | NC | NC |
| 1215 | 1967 | ACAATTGCTAGATTCTTTTT | 2 | NC | NC | NC |
| 1216 | 1968 | CACAATTGCTAGATTCTTTT | 2 | NC | NC | NC |
| 1217 | 1969 | CCACAATTGCTAGATTCTTT | 2 | NC | NC | NC |
| 1218 | 1970 | TCCACAATTGCTAGATTCTT | 2 | NC | NC | NC |
| 1219 | 1971 | TTCCACAATTGCTAGATTCT | 2 | NC | NC | NC |
| 1220 | 1972 | CTTCCACAATTGCTAGATTC | 2 | NC | NC | NC |
| 1221 | 1973 | TCTTCCACAATTGCTAGATT | 2 | NC | NC | NC |
| 1222 | 1974 | TTCTTCCACAATTGCTAGAT | 2 | NC | NC | NC |
| 1223 | 1975 | CTTCTTCCACAATTGCTAGA | 2 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 1224 | 1976 | TCTTCTTCCACAATTGCTAG | 2 | NC | NC | NC |
| 1225 | 1977 | TTCTTCTTCCACAATTGCTA | 2 | NC | NC | NC |
| 1226 | 1978 | TTTCTTCTTCCACAATTGCT | 1 | NC | NC | NC |
| 1227 | 1979 | ATTTCTTCTTCCACAATTGC | 2 | NC | NC | NC |
| 1228 | 1980 | CATTTCTTCTTCCACAATTG | 2 | NC | NC | NC |
| 1229 | 1981 | ACATTTCTTCTTCCACAATT | 2 | NC | NC | NC |
| 1230 | 1982 | AACATTTCTTCTTCCACAAT | 1 | NC | NC | NC |
| 1231 | 1983 | AAACATTTCTTCTTCCACAA | 1 | NC | NC | NC |
| 1232 | 1984 | AAAACATTTCTTCTTCCACA | 1 | NC | NC | NC |
| 1233 | 1985 | AAAAACATTTCTTCTTCCAC | 1 | NC | NC | NC |
| 1234 | 1986 | TAAAAACATTTCTTCTTCCA | 1 | NC | NC | NC |
| 1235 | 1987 | CTAAAAACATTTCTTCTTCC | 2 | NC | NC | NC |
| 1236 | 1988 | ACTAAAAACATTTCTTCTTC | 1 | NC | NC | NC |
| 1237 | 1993 | CCATAACTAAAAACATTTCT | 2 | NC | NC | NC |
| 1238 | 1994 | CCCATAACTAAAAACATTTC | 2 | NC | NC | NC |
| 1239 | 1995 | GCCCATAACTAAAAACATTT | 2 | NC | NC | NC |
| 1240 | 1996 | CGCCCATAACTAAAAACATT | 3 | NC | NC | NC |
| 1241 | 1997 | TCGCCCATAACTAAAAACAT | 2 | NC | NC | NC |
| 1242 | 1998 | CTCGCCCATAACTAAAAACA | 2 | NC | NC | NC |
| 1243 | 1999 | ACTCGCCCATAACTAAAAAC | 3 | NC | NC | NC |
| 1244 | 2000 | AACTCGCCCATAACTAAAAA | 2 | NC | NC | NC |
| 1245 | 2001 | TAACTCGCCCATAACTAAAA | 2 | NC | NC | NC |
| 1246 | 2002 | TTAACTCGCCCATAACTAAA | 3 | NC | NC | NC |
| 1247 | 2003 | TTTAACTCGCCCATAACTAA | 3 | NC | NC | NC |
| 1248 | 2004 | ATTTAACTCGCCCATAACTA | 3 | NC | NC | NC |
| 1249 | 2005 | AATTTAACTCGCCCATAACT | 3 | NC | NC | NC |
| 1250 | 2006 | TAATTTAACTCGCCCATAAC | 2 | NC | NC | NC |
| 1251 | 2007 | ATAATTTAACTCGCCCATAA | 2 | NC | NC | NC |
| 1252 | 2008 | CATAATTTAACTCGCCCATA | 3 | NC | NC | NC |
| 1253 | 2009 | ACATAATTTAACTCGCCCAT | 3 | NC | NC | NC |
| 1254 | 2010 | AACATAATTTAACTCGCCCA | 3 | NC | NC | NC |
| 1255 | 2011 | GAACATAATTTAACTCGCCC | 3 | NC | NC | NC |
| 1256 | 2012 | GGAACATAATTTAACTCGCC | 2 | NC | NC | NC |
| 1257 | 2013 | TGGAACATAATTTAACTCGC | 2 | NC | NC | NC |
| 1258 | 2027 | AGTTATAAAGCCAGTGGAAC | 2 | 2 | NC | NC |
| 1259 | 2028 | GAGTTATAAAGCCAGTGGAA | 2 | 2 | NC | NC |
| 1260 | 2029 | TGAGTTATAAAGCCAGTGGA | 2 | 1 | 2 | NC |

TABLE 2-continued

| Exemplary Oligonucleotides | | | | | | |
|---|---|---|---|---|---|---|
| SEQ | | | Off-target Score | | | |
| ID NO | Position | Sequence | Human | Cyno | Mouse | Rat |
| 1261 | 2030 | ATGAGTTATAAAGCCAGTGG | 2 | 2 | 2 | NC |
| 1262 | 2031 | CATGAGTTATAAAGCCAGTG | 2 | NC | NC | NC |
| 1263 | 2032 | ACATGAGTTATAAAGCCAGT | 2 | NC | NC | NC |
| 1264 | 2033 | TACATGAGTTATAAAGCCAG | 2 | NC | NC | NC |
| 1265 | 2034 | CTACATGAGTTATAAAGCCA | 2 | NC | NC | NC |
| 1266 | 2035 | ACTACATGAGTTATAAAGCC | 2 | NC | NC | NC |
| 1267 | 2045 | TTCATTTTGTACTACATGAG | 2 | NC | NC | NC |
| 1268 | 2046 | TTTCATTTTGTACTACATGA | 1 | NC | NC | NC |
| 1269 | 2047 | TTTTCATTTTGTACTACATG | 1 | NC | NC | NC |
| 1270 | 2065 | GTTTCAGTTGATTTAGTTTT | 2 | 2 | NC | NC |
| 1271 | 2066 | TGTTTCAGTTGATTTAGTTT | 2 | 1 | NC | NC |
| 1272 | 2067 | CTGTTTCAGTTGATTTAGTT | 2 | 2 | NC | NC |
| 1273 | 2068 | TCTGTTTCAGTTGATTTAGT | 2 | 2 | NC | NC |
| 1274 | 2069 | TTCTGTTTCAGTTGATTTAG | 2 | 1 | 2 | NC |
| 1275 | 2070 | GTTCTGTTTCAGTTGATTTA | 2 | 2 | 2 | NC |
| 1276 | 2071 | TGTTCTGTTTCAGTTGATTT | 1 | 1 | 1 | NC |
| 1277 | 2072 | ATGTTCTGTTTCAGTTGATT | 1 | 1 | 2 | NC |
| 1278 | 2073 | AATGTTCTGTTTCAGTTGAT | 1 | NC | NC | NC |
| 1279 | 2074 | GAATGTTCTGTTTCAGTTGA | 2 | NC | NC | NC |
| 1280 | 2075 | TGAATGTTCTGTTTCAGTTG | 2 | NC | NC | NC |
| 1281 | 2076 | ATGAATGTTCTGTTTCAGTT | 2 | NC | NC | NC |
| 1282 | 2077 | AATGAATGTTCTGTTTCAGT | 2 | NC | NC | NC |
| 1283 | 2078 | AAATGAATGTTCTGTTTCAG | 2 | NC | NC | NC |
| 1284 | 2079 | TAAATGAATGTTCTGTTTCA | 1 | NC | NC | NC |
| 1285 | 2080 | TTAAATGAATGTTCTGTTTC | 1 | NC | NC | NC |
| 1286 | 2097 | CAGGTCTAACATAATTTTTA | 1 | 1 | NC | NC |
| 1287 | 2098 | CCAGGTCTAACATAATTTTT | 2 | 1 | NC | NC |
| 1288 | 2099 | ACCAGGTCTAACATAATTTT | 2 | 1 | NC | NC |
| 1289 | 2100 | GACCAGGTCTAACATAATTT | 3 | 2 | NC | NC |
| 1290 | 2101 | GGACCAGGTCTAACATAATT | 3 | 2 | NC | NC |
| 1291 | 2102 | GGGACCAGGTCTAACATAAT | 3 | 2 | NC | NC |
| 1292 | 2103 | TGGGACCAGGTCTAACATAA | 3 | 2 | NC | NC |
| 1293 | 2104 | GTGGGACCAGGTCTAACATA | 3 | 3 | NC | NC |
| 1294 | 2105 | TGTGGGACCAGGTCTAACAT | 2 | 2 | NC | NC |
| 1295 | 2106 | GTGTGGGACCAGGTCTAACA | 2 | 3 | NC | NC |
| 1296 | 2108 | ACGTGTGGGACCAGGTCTAA | 2 | 2 | NC | NC |
| 1297 | 2118 | TTTCTTGGGCACGTGTGGGA | 2 | 1 | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 1298 | 2120 | TGTTTCTTGGGCACGTGTGG | 2 | 3 | NC | NC |
| 1299 | 2121 | ATGTTTCTTGGGCACGTGTG | 2 | 2 | NC | NC |
| 1300 | 2122 | AATGTTTCTTGGGCACGTGT | 2 | 2 | NC | NC |
| 1301 | 2123 | AAATGTTTCTTGGGCACGTG | 2 | 2 | NC | NC |
| 1302 | 2124 | CAAATGTTTCTTGGGCACGT | 2 | 2 | NC | NC |
| 1303 | 2131 | CTATTTCCAAATGTTTCTTG | 1 | 2 | NC | NC |
| 1304 | 2132 | TCTATTTCCAAATGTTTCTT | 1 | 2 | NC | NC |
| 1305 | 2133 | TTCTATTTCCAAATGTTTCT | 1 | 1 | NC | NC |
| 1306 | 2134 | GTTCTATTTCCAAATGTTTC | 2 | 2 | NC | NC |
| 1307 | 2135 | TGTTCTATTTCCAAATGTTT | 1 | 1 | NC | NC |
| 1308 | 2136 | GTGTTCTATTTCCAAATGTT | 2 | 1 | NC | NC |
| 1309 | 2137 | CGTGTTCTATTTCCAAATGT | 2 | 2 | NC | NC |
| 1310 | 2138 | ACGTGTTCTATTTCCAAATG | 2 | 2 | NC | NC |
| 1311 | 2139 | GACGTGTTCTATTTCCAAAT | 2 | 2 | NC | NC |
| 1312 | 2140 | TGACGTGTTCTATTTCCAAA | 2 | 2 | NC | NC |
| 1313 | 2141 | ATGACGTGTTCTATTTCCAA | 2 | 2 | NC | NC |
| 1314 | 2142 | AATGACGTGTTCTATTTCCA | 2 | 2 | NC | NC |
| 1315 | 2143 | GAATGACGTGTTCTATTTCC | 2 | 2 | NC | NC |
| 1316 | 2144 | TGAATGACGTGTTCTATTTC | 2 | 2 | NC | NC |
| 1317 | 2145 | CTGAATGACGTGTTCTATTT | 2 | 2 | NC | NC |
| 1318 | 2146 | ACTGAATGACGTGTTCTATT | 2 | 2 | NC | NC |
| 1319 | 2147 | AACTGAATGACGTGTTCTAT | 2 | 2 | NC | NC |
| 1320 | 2148 | CAACTGAATGACGTGTTCTA | 2 | 2 | NC | NC |
| 1321 | 2149 | TCAACTGAATGACGTGTTCT | 2 | 3 | NC | NC |
| 1322 | 2150 | TTCAACTGAATGACGTGTTC | 3 | 3 | NC | NC |
| 1323 | 2151 | TTTCAACTGAATGACGTGTT | 2 | 2 | NC | NC |
| 1324 | 2152 | GTTTCAACTGAATGACGTGT | 3 | 2 | NC | NC |
| 1325 | 2153 | AGTTTCAACTGAATGACGTG | 2 | 3 | NC | NC |
| 1326 | 2164 | TTGATGTCTGGAGTTTCAAC | 2 | NC | NC | NC |
| 1327 | 2165 | TTTGATGTCTGGAGTTTCAA | 2 | NC | NC | NC |
| 1328 | 2166 | CTTTGATGTCTGGAGTTTCA | 1 | NC | NC | NC |
| 1329 | 2167 | TCTTTGATGTCTGGAGTTTC | 2 | NC | NC | NC |
| 1330 | 2168 | ATCTTTGATGTCTGGAGTTT | 2 | NC | NC | NC |
| 1331 | 2169 | AATCTTTGATGTCTGGAGTT | 2 | NC | NC | NC |
| 1332 | 2170 | AAATCTTTGATGTCTGGAGT | 2 | NC | NC | NC |
| 1333 | 2171 | TAAATCTTTGATGTCTGGAG | 2 | NC | NC | NC |
| 1334 | 2172 | CTAAATCTTTGATGTCTGGA | 2 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 1335 | 2173 | GCTAAATCTTTGATGTCTGG | 2 | NC | NC | NC |
| 1336 | 2174 | GGCTAAATCTTTGATGTCTG | 2 | NC | NC | NC |
| 1337 | 2175 | TGGCTAAATCTTTGATGTCT | 2 | NC | NC | NC |
| 1338 | 2176 | CTGGCTAAATCTTTGATGTC | 2 | NC | NC | NC |
| 1339 | 2177 | GCTGGCTAAATCTTTGATGT | 2 | NC | NC | NC |
| 1340 | 2178 | TGCTGGCTAAATCTTTGATG | 2 | NC | NC | NC |
| 1341 | 2179 | GTGCTGGCTAAATCTTTGAT | 2 | NC | NC | NC |
| 1342 | 2180 | AGTGCTGGCTAAATCTTTGA | 2 | NC | NC | NC |
| 1343 | 2181 | AAGTGCTGGCTAAATCTTTG | 2 | NC | NC | NC |
| 1344 | 2182 | AAAGTGCTGGCTAAATCTTT | 2 | NC | NC | NC |
| 1345 | 2183 | TAAAGTGCTGGCTAAATCTT | 2 | NC | NC | NC |
| 1346 | 2184 | TTAAAGTGCTGGCTAAATCT | 2 | NC | NC | NC |
| 1347 | 2185 | CTTAAAGTGCTGGCTAAATC | 2 | NC | NC | NC |
| 1348 | 2186 | ACTTAAAGTGCTGGCTAAAT | 2 | NC | NC | NC |
| 1349 | 2187 | TACTTAAAGTGCTGGCTAAA | 2 | NC | NC | NC |
| 1350 | 2188 | TTACTTAAAGTGCTGGCTAA | 2 | NC | NC | NC |
| 1351 | 2189 | TTTACTTAAAGTGCTGGCTA | 2 | NC | NC | NC |
| 1352 | 2190 | CTTTACTTAAAGTGCTGGCT | 2 | NC | NC | NC |
| 1353 | 2199 | GACCAGATTCTTTACTTAAA | 2 | NC | NC | NC |
| 1354 | 2200 | TGACCAGATTCTTTACTTAA | 1 | NC | NC | NC |
| 1355 | 2201 | TTGACCAGATTCTTTACTTA | 1 | NC | NC | NC |
| 1356 | 2202 | ATTGACCAGATTCTTTACTT | 1 | NC | NC | NC |
| 1357 | 2203 | AATTGACCAGATTCTTTACT | 2 | NC | NC | NC |
| 1358 | 2204 | CAATTGACCAGATTCTTTAC | 2 | NC | NC | NC |
| 1359 | 2205 | GCAATTGACCAGATTCTTTA | 2 | NC | NC | NC |
| 1360 | 2206 | GGCAATTGACCAGATTCTTT | 1 | NC | NC | NC |
| 1361 | 2233 | ATATTCGTTCTGCAATTTTT | 2 | NC | NC | NC |
| 1362 | 2234 | TATATTCGTTCTGCAATTTT | 2 | NC | NC | NC |
| 1363 | 2235 | TTATATTCGTTCTGCAATTT | 2 | NC | NC | NC |
| 1364 | 2236 | CTTATATTCGTTCTGCAATT | 2 | NC | NC | NC |
| 1365 | 2237 | ACTTATATTCGTTCTGCAAT | 2 | NC | NC | NC |
| 1366 | 2238 | AACTTATATTCGTTCTGCAA | 2 | NC | NC | NC |
| 1367 | 2239 | TAACTTATATTCGTTCTGCA | 2 | NC | NC | NC |
| 1368 | 2240 | ATAACTTATATTCGTTCTGC | 2 | NC | NC | NC |
| 1369 | 2241 | CATAACTTATATTCGTTCTG | 2 | NC | NC | NC |
| 1370 | 2242 | CCATAACTTATATTCGTTCT | 2 | NC | NC | NC |
| 1371 | 2243 | CCCATAACTTATATTCGTTC | 2 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 1372 | 2244 | GCCCATAACTTATATTCGTT | 3 | NC | NC | NC |
| 1373 | 2245 | AGCCCATAACTTATATTCGT | 2 | NC | NC | NC |
| 1374 | 2246 | TAGCCCATAACTTATATTCG | 3 | NC | NC | NC |
| 1375 | 2247 | CTAGCCCATAACTTATATTC | 2 | NC | NC | NC |
| 1376 | 2248 | TCTAGCCCATAACTTATATT | 2 | NC | NC | NC |
| 1377 | 2249 | CTCTAGCCCATAACTTATAT | 2 | NC | NC | NC |
| 1378 | 2250 | TCTCTAGCCCATAACTTATA | 2 | NC | NC | NC |
| 1379 | 2251 | TTCTCTAGCCCATAACTTAT | 2 | NC | NC | NC |
| 1380 | 2252 | ATTCTCTAGCCCATAACTTA | 2 | NC | NC | NC |
| 1381 | 2253 | CATTCTCTAGCCCATAACTT | 1 | NC | NC | NC |
| 1382 | 2254 | TCATTCTCTAGCCCATAACT | 2 | NC | NC | NC |
| 1383 | 2255 | TTCATTCTCTAGCCCATAAC | 2 | NC | NC | NC |
| 1384 | 2256 | GTTCATTCTCTAGCCCATAA | 2 | NC | NC | NC |
| 1385 | 2257 | GGTTCATTCTCTAGCCCATA | 2 | NC | NC | NC |
| 1386 | 2258 | AGGTTCATTCTCTAGCCCAT | 2 | NC | NC | NC |
| 1387 | 2259 | TAGGTTCATTCTCTAGCCCA | 2 | 2 | NC | NC |
| 1388 | 2260 | GTAGGTTCATTCTCTAGCCC | 2 | 2 | NC | NC |
| 1389 | 2261 | TGTAGGTTCATTCTCTAGCC | 2 | 2 | NC | NC |
| 1390 | 2262 | CTGTAGGTTCATTCTCTAGC | 2 | 2 | NC | NC |
| 1391 | 2263 | GCTGTAGGTTCATTCTCTAG | 2 | 2 | NC | NC |
| 1392 | 2264 | TGCTGTAGGTTCATTCTCTA | 2 | 2 | NC | NC |
| 1393 | 2265 | TTGCTGTAGGTTCATTCTCT | 2 | 2 | NC | NC |
| 1394 | 2266 | GTTGCTGTAGGTTCATTCTC | 2 | 2 | NC | NC |
| 1395 | 2267 | AGTTGCTGTAGGTTCATTCT | 2 | 2 | NC | NC |
| 1396 | 2268 | AAGTTGCTGTAGGTTCATTC | 2 | 2 | NC | NC |
| 1397 | 2269 | TAAGTTGCTGTAGGTTCATT | 2 | 2 | NC | NC |
| 1398 | 2270 | ATAAGTTGCTGTAGGTTCAT | 2 | 2 | NC | NC |
| 1399 | 2271 | TATAAGTTGCTGTAGGTTCA | 2 | NC | NC | NC |
| 1400 | 2272 | GTATAAGTTGCTGTAGGTTC | 1 | NC | NC | NC |
| 1401 | 2273 | TGTATAAGTTGCTGTAGGTT | 2 | NC | NC | NC |
| 1402 | 2274 | TTGTATAAGTTGCTGTAGGT | 2 | NC | NC | NC |
| 1403 | 2275 | ATTGTATAAGTTGCTGTAGG | 2 | NC | NC | NC |
| 1404 | 2276 | CATTGTATAAGTTGCTGTAG | 2 | NC | NC | NC |
| 1405 | 2277 | ACATTGTATAAGTTGCTGTA | 1 | NC | NC | NC |
| 1406 | 2278 | AACATTGTATAAGTTGCTGT | 2 | NC | NC | NC |
| 1407 | 2279 | AAACATTGTATAAGTTGCTG | 2 | NC | NC | NC |
| 1408 | 2280 | AAAACATTGTATAAGTTGCT | 2 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 1409 | 2281 | GAAAACATTGTATAAGTTGC | 2 | NC | NC | NC |
| 1410 | 2282 | AGAAAACATTGTATAAGTTG | 1 | NC | NC | NC |
| 1411 | 2283 | CAGAAAACATTGTATAAGTT | 2 | NC | NC | NC |
| 1412 | 2284 | GCAGAAAACATTGTATAAGT | 2 | NC | NC | NC |
| 1413 | 2285 | AGCAGAAAACATTGTATAAG | 2 | NC | NC | NC |
| 1414 | 2286 | AAGCAGAAAACATTGTATAA | 1 | NC | NC | NC |
| 1415 | 2287 | AAAGCAGAAAACATTGTATA | 1 | NC | NC | NC |
| 1416 | 2288 | AAAAGCAGAAAACATTGTAT | 2 | NC | NC | NC |
| 1417 | 2289 | GAAAAGCAGAAAACATTGTA | 1 | NC | NC | NC |
| 1418 | 2290 | TGAAAAGCAGAAAACATTGT | 2 | NC | NC | NC |
| 1419 | 2301 | TGCTACCTTCCTGAAAAGCA | 2 | NC | NC | NC |
| 1420 | 2302 | TTGCTACCTTCCTGAAAAGC | 2 | NC | NC | NC |
| 1421 | 2303 | TTTGCTACCTTCCTGAAAAG | 2 | NC | NC | NC |
| 1422 | 2304 | TTTTGCTACCTTCCTGAAAA | 1 | NC | NC | NC |
| 1423 | 2305 | TTTTTGCTACCTTCCTGAAA | 1 | NC | NC | NC |
| 1424 | 2321 | GCAATCTGTTTGTGATTTTT | 2 | NC | NC | NC |
| 1425 | 2322 | TGCAATCTGTTTGTGATTTT | 2 | NC | NC | NC |
| 1426 | 2323 | ATGCAATCTGTTTGTGATTT | 2 | NC | NC | NC |
| 1427 | 2324 | TATGCAATCTGTTTGTGATT | 2 | NC | NC | NC |
| 1428 | 2325 | ATATGCAATCTGTTTGTGAT | 2 | NC | NC | NC |
| 1429 | 2326 | AATATGCAATCTGTTTGTGA | 2 | NC | NC | NC |
| 1430 | 2327 | TAATATGCAATCTGTTTGTG | 2 | NC | NC | NC |
| 1431 | 2328 | ATAATATGCAATCTGTTTGT | 2 | NC | NC | NC |
| 1432 | 2330 | AGATAATATGCAATCTGTTT | 1 | NC | NC | NC |
| 1433 | 2334 | TATCAGATAATATGCAATCT | 2 | NC | NC | NC |
| 1434 | 2335 | GTATCAGATAATATGCAATC | 2 | NC | NC | NC |
| 1435 | 2336 | TGTATCAGATAATATGCAAT | 1 | NC | NC | NC |
| 1436 | 2337 | ATGTATCAGATAATATGCAA | 1 | 1 | NC | NC |
| 1437 | 2338 | GATGTATCAGATAATATGCA | 2 | 2 | NC | NC |
| 1438 | 2339 | GGATGTATCAGATAATATGC | 2 | 2 | NC | NC |
| 1439 | 2340 | GGGATGTATCAGATAATATG | 2 | 2 | NC | NC |
| 1440 | 2368 | GAAACGTGTCTATACCAGGG | 2 | 2 | NC | NC |
| 1441 | 2369 | GGAAACGTGTCTATACCAGG | 3 | NC | NC | NC |
| 1442 | 2370 | TGGAAACGTGTCTATACCAG | 2 | NC | NC | NC |
| 1443 | 2371 | TTGGAAACGTGTCTATACCA | 2 | NC | NC | NC |
| 1444 | 2372 | ATTGGAAACGTGTCTATACC | 3 | NC | NC | NC |
| 1445 | 2373 | CATTGGAAACGTGTCTATAC | 2 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 1446 | 2374 | TCATTGGAAACGTGTCTATA | 3 | NC | NC | NC |
| 1447 | 2375 | ATCATTGGAAACGTGTCTAT | 2 | NC | NC | NC |
| 1448 | 2376 | TATCATTGGAAACGTGTCTA | 2 | NC | NC | NC |
| 1449 | 2377 | CTATCATTGGAAACGTGTCT | 2 | NC | NC | NC |
| 1450 | 2378 | ACTATCATTGGAAACGTGTC | 2 | NC | NC | NC |
| 1451 | 2379 | TACTATCATTGGAAACGTGT | 3 | NC | NC | NC |
| 1452 | 2380 | CTACTATCATTGGAAACGTG | 3 | NC | NC | NC |
| 1453 | 2381 | CCTACTATCATTGGAAACGT | 3 | NC | NC | NC |
| 1454 | 2382 | TCCTACTATCATTGGAAACG | 3 | NC | NC | NC |
| 1455 | 2383 | TTCCTACTATCATTGGAAAC | 2 | NC | NC | NC |
| 1456 | 2385 | TTTTCCTACTATCATTGGAA | 1 | NC | NC | NC |
| 1457 | 2386 | GTTTTCCTACTATCATTGGA | 2 | NC | NC | NC |
| 1458 | 2387 | TGTTTTCCTACTATCATTGG | 2 | NC | NC | NC |
| 1459 | 2388 | CTGTTTTCCTACTATCATTG | 1 | NC | NC | NC |
| 1460 | 2389 | TCTGTTTTCCTACTATCATT | 1 | 2 | NC | NC |
| 1461 | 2390 | ATCTGTTTTCCTACTATCAT | 2 | 2 | NC | NC |
| 1462 | 2391 | TATCTGTTTTCCTACTATCA | 2 | 2 | NC | NC |
| 1463 | 2392 | TTATCTGTTTTCCTACTATC | 2 | 2 | NC | NC |
| 1464 | 2393 | TTTATCTGTTTTCCTACTAT | 1 | 2 | NC | NC |
| 1465 | 2394 | ATTTATCTGTTTTCCTACTA | 1 | 1 | NC | NC |
| 1466 | 2395 | AATTTATCTGTTTTCCTACT | 1 | 1 | NC | NC |
| 1467 | 2396 | TAATTTATCTGTTTTCCTAC | 1 | 2 | NC | NC |
| 1468 | 2405 | GAAACCAATTAATTTATCTG | 2 | NC | NC | NC |
| 1469 | 2407 | GAGAAACCAATTAATTTATC | 1 | NC | NC | NC |
| 1470 | 2421 | GGACGATTGGTTTGGAGAAA | 1 | NC | NC | NC |
| 1471 | 2422 | CGGACGATTGGTTTGGAGAA | 2 | NC | NC | NC |
| 1472 | 2423 | ACGGACGATTGGTTTGGAGA | 3 | NC | NC | NC |
| 1473 | 2424 | TACGGACGATTGGTTTGGAG | 2 | 3 | NC | NC |
| 1474 | 2425 | TTACGGACGATTGGTTTGGA | 3 | 3 | NC | NC |
| 1475 | 2426 | CTTACGGACGATTGGTTTGG | 3 | 3 | NC | NC |
| 1476 | 2427 | TCTTACGGACGATTGGTTTG | 3 | 3 | NC | NC |
| 1477 | 2428 | TTCTTACGGACGATTGGTTT | 2 | 3 | NC | NC |
| 1478 | 2429 | CTTCTTACGGACGATTGGTT | 2 | 3 | NC | NC |
| 1479 | 2430 | GCTTCTTACGGACGATTGGT | 2 | 3 | NC | NC |
| 1480 | 2431 | AGCTTCTTACGGACGATTGG | 3 | 3 | NC | NC |
| 1481 | 2432 | TAGCTTCTTACGGACGATTG | 3 | 3 | NC | NC |
| 1482 | 2433 | TTAGCTTCTTACGGACGATT | 2 | 2 | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 1483 | 2434 | CTTAGCTTCTTACGGACGAT | 2 | 2 | NC | NC |
| 1484 | 2435 | GCTTAGCTTCTTACGGACGA | 3 | 3 | NC | NC |
| 1485 | 2436 | AGCTTAGCTTCTTACGGACG | 2 | 3 | NC | NC |
| 1486 | 2448 | GCTGTGAACTCAAGCTTAGC | 3 | 3 | NC | NC |
| 1487 | 2449 | AGCTGTGAACTCAAGCTTAG | 2 | 2 | NC | NC |
| 1488 | 2450 | TAGCTGTGAACTCAAGCTTA | 1 | 1 | NC | NC |
| 1489 | 2451 | CTAGCTGTGAACTCAAGCTT | 1 | 2 | NC | NC |
| 1490 | 2453 | TCCTAGCTGTGAACTCAAGC | 2 | 2 | NC | NC |
| 1491 | 2454 | ATCCTAGCTGTGAACTCAAG | 2 | 2 | NC | NC |
| 1492 | 2455 | GATCCTAGCTGTGAACTCAA | 2 | 2 | NC | NC |
| 1493 | 2456 | AGATCCTAGCTGTGAACTCA | 2 | 2 | NC | NC |
| 1494 | 2457 | AAGATCCTAGCTGTGAACTC | 2 | 2 | NC | NC |
| 1495 | 2458 | AAAGATCCTAGCTGTGAACT | 2 | 2 | NC | NC |
| 1496 | 2459 | TAAAGATCCTAGCTGTGAAC | 2 | 2 | NC | NC |
| 1497 | 2460 | CTAAAGATCCTAGCTGTGAA | 2 | 2 | NC | NC |
| 1498 | 2461 | TCTAAAGATCCTAGCTGTGA | 2 | 2 | NC | NC |
| 1499 | 2462 | CTCTAAAGATCCTAGCTGTG | 2 | 2 | NC | NC |
| 1500 | 2463 | TCTCTAAAGATCCTAGCTGT | 2 | 2 | NC | NC |
| 1501 | 2464 | TTCTCTAAAGATCCTAGCTG | 2 | 2 | NC | NC |
| 1502 | 2465 | CTTCTCTAAAGATCCTAGCT | 2 | 2 | NC | NC |
| 1503 | 2466 | ACTTCTCTAAAGATCCTAGC | 2 | 2 | NC | NC |
| 1504 | 2467 | AACTTCTCTAAAGATCCTAG | 2 | 2 | NC | NC |
| 1505 | 2468 | AAACTTCTCTAAAGATCCTA | 2 | 2 | NC | NC |
| 1506 | 2469 | TAAACTTCTCTAAAGATCCT | 2 | 2 | NC | NC |
| 1507 | 2470 | TTAAACTTCTCTAAAGATCC | 2 | 2 | NC | NC |
| 1508 | 2471 | CTTAAACTTCTCTAAAGATC | 2 | 2 | NC | NC |
| 1509 | 2472 | TCTTAAACTTCTCTAAAGAT | 1 | 1 | NC | NC |
| 1510 | 2473 | CTCTTAAACTTCTCTAAAGA | 2 | 1 | 1 | 2 |
| 1511 | 2474 | CCTCTTAAACTTCTCTAAAG | 1 | 1 | 2 | 2 |
| 1512 | 2475 | GCCTCTTAAACTTCTCTAAA | 2 | 1 | 2 | 2 |
| 1513 | 2476 | TGCCTCTTAAACTTCTCTAA | 2 | 1 | 1 | 2 |
| 1514 | 2477 | TTGCCTCTTAAACTTCTCTA | 2 | 1 | NC | NC |
| 1515 | 2478 | ATTGCCTCTTAAACTTCTCT | 1 | 1 | NC | NC |
| 1516 | 2479 | TATTGCCTCTTAAACTTCTC | 2 | 2 | NC | NC |
| 1517 | 2480 | ATATTGCCTCTTAAACTTCT | 2 | 2 | NC | NC |
| 1518 | 2481 | CATATTGCCTCTTAAACTTC | 2 | 2 | NC | NC |
| 1519 | 2482 | CCATATTGCCTCTTAAACTT | 2 | 2 | NC | NC |

TABLE 2-continued

| Exemplary Oligonucleotides | | | | | | |
|---|---|---|---|---|---|---|
| SEQ | | | Off-target Score | | | |
| ID NO | Position | Sequence | Human | Cyno | Mouse | Rat |
| 1520 | 2483 | CCCATATTGCCTCTTAAACT | 2 | 2 | NC | NC |
| 1521 | 2484 | TCCCATATTGCCTCTTAAAC | 2 | 2 | NC | NC |
| 1522 | 2485 | TTCCCATATTGCCTCTTAAA | 2 | 2 | NC | NC |
| 1523 | 2486 | CTTCCCATATTGCCTCTTAA | 2 | 2 | NC | NC |
| 1524 | 2487 | CCTTCCCATATTGCCTCTTA | 2 | 2 | NC | NC |
| 1525 | 2488 | ACCTTCCCATATTGCCTCTT | 2 | 2 | NC | NC |
| 1526 | 2489 | AACCTTCCCATATTGCCTCT | 2 | 2 | NC | NC |
| 1527 | 2490 | CAACCTTCCCATATTGCCTC | 2 | 2 | NC | NC |
| 1528 | 2491 | TCAACCTTCCCATATTGCCT | 2 | 2 | NC | NC |
| 1529 | 2492 | TTCAACCTTCCCATATTGCC | 2 | 2 | NC | NC |
| 1530 | 2493 | TTTCAACCTTCCCATATTGC | 2 | 2 | NC | NC |
| 1531 | 2494 | TTTTCAACCTTCCCATATTG | 2 | 2 | NC | NC |
| 1532 | 2495 | ATTTTCAACCTTCCCATATT | 1 | 1 | NC | NC |
| 1533 | 2496 | GATTTTCAACCTTCCCATAT | 2 | 2 | NC | NC |
| 1534 | 2497 | GGATTTTCAACCTTCCCATA | 1 | 2 | NC | NC |
| 1535 | 2498 | AGGATTTTCAACCTTCCCAT | 2 | 2 | NC | NC |
| 1536 | 2499 | GAGGATTTTCAACCTTCCCA | 1 | 2 | NC | NC |
| 1537 | 2500 | AGAGGATTTTCAACCTTCCC | 1 | 1 | NC | NC |
| 1538 | 2501 | CAGAGGATTTTCAACCTTCC | 2 | 2 | NC | NC |
| 1539 | 2502 | CCAGAGGATTTTCAACCTTC | 1 | 2 | NC | NC |
| 1540 | 2503 | TCCAGAGGATTTTCAACCTT | 1 | 1 | NC | NC |
| 1541 | 2504 | ATCCAGAGGATTTTCAACCT | 1 | 1 | NC | NC |
| 1542 | 2505 | TATCCAGAGGATTTTCAACC | 2 | 2 | NC | NC |
| 1543 | 2506 | GTATCCAGAGGATTTTCAAC | 2 | 2 | NC | NC |
| 1544 | 2507 | TGTATCCAGAGGATTTTCAA | 1 | 1 | NC | NC |
| 1545 | 2508 | CTGTATCCAGAGGATTTTCA | 2 | 2 | NC | NC |
| 1546 | 2519 | TTCCTCTACTTCTGTATCCA | 2 | 2 | NC | NC |
| 1547 | 2520 | TTTCCTCTACTTCTGTATCC | 2 | 2 | NC | NC |
| 1548 | 2521 | CTTTCCTCTACTTCTGTATC | 2 | 2 | NC | NC |
| 1549 | 2522 | ACTTTCCTCTACTTCTGTAT | 2 | 1 | NC | NC |
| 1550 | 2523 | TACTTTCCTCTACTTCTGTA | 1 | 1 | NC | NC |
| 1551 | 2524 | TTACTTTCCTCTACTTCTGT | 2 | 2 | NC | NC |
| 1552 | 2525 | ATTACTTTCCTCTACTTCTG | 2 | NC | NC | NC |
| 1553 | 2526 | CATTACTTTCCTCTACTTCT | 1 | NC | NC | NC |
| 1554 | 2527 | CCATTACTTTCCTCTACTTC | 1 | NC | NC | NC |
| 1555 | 2528 | TCCATTACTTTCCTCTACTT | 0 | NC | NC | NC |
| 1556 | 2529 | CTCCATTACTTTCCTCTACT | 0 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 1557 | 2530 | ACTCCATTACTTTCCTCTAC | 0 | NC | NC | NC |
| 1558 | 2531 | GACTCCATTACTTTCCTCTA | 1 | NC | NC | NC |
| 1559 | 2532 | TGACTCCATTACTTTCCTCT | 1 | NC | NC | NC |
| 1560 | 2533 | GTGACTCCATTACTTTCCTC | 1 | NC | NC | NC |
| 1561 | 2534 | AGTGACTCCATTACTTTCCT | 2 | NC | NC | NC |
| 1562 | 2535 | TAGTGACTCCATTACTTTCC | 2 | NC | NC | NC |
| 1563 | 2536 | GTAGTGACTCCATTACTTTC | 2 | NC | NC | NC |
| 1564 | 2537 | GGTAGTGACTCCATTACTTT | 2 | NC | NC | NC |
| 1565 | 2538 | TGGTAGTGACTCCATTACTT | 3 | NC | NC | NC |
| 1566 | 2539 | TTGGTAGTGACTCCATTACT | 2 | NC | NC | NC |
| 1567 | 2540 | ATTGGTAGTGACTCCATTAC | 2 | NC | NC | NC |
| 1568 | 2541 | GATTGGTAGTGACTCCATTA | 3 | NC | NC | NC |
| 1569 | 2542 | AGATTGGTAGTGACTCCATT | 1 | NC | NC | NC |
| 1570 | 2543 | GAGATTGGTAGTGACTCCAT | 2 | NC | NC | NC |
| 1571 | 2544 | TGAGATTGGTAGTGACTCCA | 2 | NC | NC | NC |
| 1572 | 2545 | CTGAGATTGGTAGTGACTCC | 2 | 3 | NC | NC |
| 1573 | 2546 | ACTGAGATTGGTAGTGACTC | 2 | 3 | NC | NC |
| 1574 | 2547 | GACTGAGATTGGTAGTGACT | 2 | 2 | NC | NC |
| 1575 | 2548 | AGACTGAGATTGGTAGTGAC | 2 | NC | NC | NC |
| 1576 | 2549 | AAGACTGAGATTGGTAGTGA | 2 | NC | NC | NC |
| 1577 | 2550 | GAAGACTGAGATTGGTAGTG | 2 | NC | NC | NC |
| 1578 | 2551 | TGAAGACTGAGATTGGTAGT | 2 | NC | NC | NC |
| 1579 | 2552 | TTGAAGACTGAGATTGGTAG | 2 | NC | NC | NC |
| 1580 | 2553 | CTTGAAGACTGAGATTGGTA | 1 | NC | NC | NC |
| 1581 | 2554 | ACTTGAAGACTGAGATTGGT | 2 | NC | NC | NC |
| 1582 | 2555 | AACTTGAAGACTGAGATTGG | 2 | NC | NC | NC |
| 1583 | 2556 | CAACTTGAAGACTGAGATTG | 2 | NC | NC | NC |
| 1584 | 2557 | TCAACTTGAAGACTGAGATT | 1 | NC | NC | NC |
| 1585 | 2558 | TTCAACTTGAAGACTGAGAT | 2 | NC | NC | NC |
| 1586 | 2559 | GTTCAACTTGAAGACTGAGA | 2 | NC | NC | NC |
| 1587 | 2560 | GGTTCAACTTGAAGACTGAG | 2 | NC | NC | NC |
| 1588 | 2561 | AGGTTCAACTTGAAGACTGA | 2 | NC | NC | NC |
| 1589 | 2562 | CAGGTTCAACTTGAAGACTG | 2 | NC | NC | NC |
| 1590 | 2563 | TCAGGTTCAACTTGAAGACT | 2 | NC | NC | NC |
| 1591 | 2564 | GTCAGGTTCAACTTGAAGAC | 2 | NC | NC | NC |
| 1592 | 2565 | TGTCAGGTTCAACTTGAAGA | 2 | NC | NC | NC |
| 1593 | 2566 | ATGTCAGGTTCAACTTGAAG | 2 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 1594 | 2567 | AATGTCAGGTTCAACTTGAA | 2 | NC | NC | NC |
| 1595 | 2568 | GAATGTCAGGTTCAACTTGA | 2 | 2 | NC | NC |
| 1596 | 2569 | AGAATGTCAGGTTCAACTTG | 2 | 2 | NC | NC |
| 1597 | 2570 | CAGAATGTCAGGTTCAACTT | 2 | 2 | NC | NC |
| 1598 | 2584 | TTCTTGTCCTTCAGCAGAAT | 2 | NC | NC | NC |
| 1599 | 2585 | GTTCTTGTCCTTCAGCAGAA | 1 | NC | NC | NC |
| 1600 | 2586 | GGTTCTTGTCCTTCAGCAGA | 2 | NC | NC | NC |
| 1601 | 2587 | CGGTTCTTGTCCTTCAGCAG | 2 | NC | NC | NC |
| 1602 | 2588 | GCGGTTCTTGTCCTTCAGCA | 2 | NC | NC | NC |
| 1603 | 2589 | AGCGGTTCTTGTCCTTCAGC | 1 | NC | NC | NC |
| 1604 | 2590 | AAGCGGTTCTTGTCCTTCAG | 1 | NC | NC | NC |
| 1605 | 2591 | TAAGCGGTTCTTGTCCTTCA | 2 | NC | NC | NC |
| 1606 | 2592 | CTAAGCGGTTCTTGTCCTTC | 2 | NC | NC | NC |
| 1607 | 2593 | TCTAAGCGGTTCTTGTCCTT | 3 | NC | NC | NC |
| 1608 | 2594 | CTCTAAGCGGTTCTTGTCCT | 3 | NC | NC | NC |
| 1609 | 2595 | TCTCTAAGCGGTTCTTGTCC | 2 | NC | NC | NC |
| 1610 | 2596 | TTCTCTAAGCGGTTCTTGTC | 2 | NC | NC | NC |
| 1611 | 2597 | GTTCTCTAAGCGGTTCTTGT | 2 | NC | NC | NC |
| 1612 | 2598 | AGTTCTCTAAGCGGTTCTTG | 2 | NC | NC | NC |
| 1613 | 2600 | AGAGTTCTCTAAGCGGTTCT | 2 | NC | NC | NC |
| 1614 | 2601 | CAGAGTTCTCTAAGCGGTTC | 3 | NC | NC | NC |
| 1615 | 2602 | TCAGAGTTCTCTAAGCGGTT | 3 | NC | NC | NC |
| 1616 | 2603 | ATCAGAGTTCTCTAAGCGGT | 3 | NC | NC | NC |
| 1617 | 2604 | CATCAGAGTTCTCTAAGCGG | 3 | NC | NC | NC |
| 1618 | 2605 | ACATCAGAGTTCTCTAAGCG | 2 | NC | NC | NC |
| 1619 | 2606 | AACATCAGAGTTCTCTAAGC | 1 | NC | NC | NC |
| 1620 | 2607 | AAACATCAGAGTTCTCTAAG | 1 | NC | NC | NC |
| 1621 | 2608 | CAAACATCAGAGTTCTCTAA | 1 | NC | NC | NC |
| 1622 | 2609 | ACAAACATCAGAGTTCTCTA | 1 | NC | NC | NC |
| 1623 | 2610 | TACAAACATCAGAGTTCTCT | 2 | NC | NC | NC |
| 1624 | 2611 | TTACAAACATCAGAGTTCTC | 2 | NC | NC | NC |
| 1625 | 2612 | TTTACAAACATCAGAGTTCT | 2 | NC | NC | NC |
| 1626 | 2613 | TTTTACAAACATCAGAGTTC | 2 | NC | NC | NC |
| 1627 | 2614 | ATTTTACAAACATCAGAGTT | 2 | 2 | NC | NC |
| 1628 | 2615 | GATTTTACAAACATCAGAGT | 2 | 1 | NC | NC |
| 1629 | 2616 | TGATTTTACAAACATCAGAG | 2 | 2 | NC | NC |
| 1630 | 2617 | GTGATTTTACAAACATCAGA | 1 | 1 | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 1631 | 2618 | AGTGATTTTACAAACATCAG | 2 | 1 | NC | NC |
| 1632 | 2619 | TAGTGATTTTACAAACATCA | 2 | 1 | NC | NC |
| 1633 | 2620 | GTAGTGATTTTACAAACATC | 2 | 2 | NC | NC |
| 1634 | 2621 | AGTAGTGATTTTACAAACAT | 2 | 2 | NC | NC |
| 1635 | 2622 | TAGTAGTGATTTTACAAACA | 1 | 2 | NC | NC |
| 1636 | 2623 | ATAGTAGTGATTTTACAAAC | 2 | 2 | NC | NC |
| 1637 | 2624 | CATAGTAGTGATTTTACAAA | 2 | 1 | NC | NC |
| 1638 | 2625 | CCATAGTAGTGATTTTACAA | 2 | NC | NC | NC |
| 1639 | 2626 | TCCATAGTAGTGATTTTACA | 2 | NC | NC | NC |
| 1640 | 2627 | CTCCATAGTAGTGATTTTAC | 2 | NC | NC | NC |
| 1641 | 2628 | GCTCCATAGTAGTGATTTTA | 2 | NC | NC | NC |
| 1642 | 2629 | TGCTCCATAGTAGTGATTTT | 2 | NC | NC | NC |
| 1643 | 2630 | ATGCTCCATAGTAGTGATTT | 2 | NC | NC | NC |
| 1644 | 2631 | TATGCTCCATAGTAGTGATT | 3 | NC | NC | NC |
| 1645 | 2632 | CTATGCTCCATAGTAGTGAT | 3 | NC | NC | NC |
| 1646 | 2640 | CTGAATCACTATGCTCCATA | 2 | NC | NC | NC |
| 1647 | 2641 | TCTGAATCACTATGCTCCAT | 2 | NC | NC | NC |
| 1648 | 2642 | ATCTGAATCACTATGCTCCA | 2 | NC | NC | NC |
| 1649 | 2643 | TATCTGAATCACTATGCTCC | 2 | NC | NC | NC |
| 1650 | 2644 | CTATCTGAATCACTATGCTC | 2 | NC | NC | NC |
| 1651 | 2645 | ACTATCTGAATCACTATGCT | 2 | NC | NC | NC |
| 1652 | 2646 | TACTATCTGAATCACTATGC | 2 | NC | NC | NC |
| 1653 | 2647 | CTACTATCTGAATCACTATG | 2 | NC | NC | NC |
| 1654 | 2648 | ACTACTATCTGAATCACTAT | 2 | NC | NC | NC |
| 1655 | 2649 | AACTACTATCTGAATCACTA | 2 | NC | NC | NC |
| 1656 | 2650 | CAACTACTATCTGAATCACT | 1 | NC | NC | NC |
| 1657 | 2651 | ACAACTACTATCTGAATCAC | 1 | NC | NC | NC |
| 1658 | 2652 | GACAACTACTATCTGAATCA | 2 | NC | NC | NC |
| 1659 | 2653 | TGACAACTACTATCTGAATC | 2 | NC | NC | NC |
| 1660 | 2654 | TTGACAACTACTATCTGAAT | 1 | NC | NC | NC |
| 1661 | 2655 | GTTGACAACTACTATCTGAA | 2 | NC | NC | NC |
| 1662 | 2656 | GGTTGACAACTACTATCTGA | 2 | NC | NC | NC |
| 1663 | 2657 | TGGTTGACAACTACTATCTG | 2 | NC | NC | NC |
| 1664 | 2658 | CTGGTTGACAACTACTATCT | 1 | NC | NC | NC |
| 1665 | 2659 | GCTGGTTGACAACTACTATC | 2 | NC | NC | NC |
| 1666 | 2660 | TGCTGGTTGACAACTACTAT | 2 | NC | NC | NC |
| 1667 | 2661 | TTGCTGGTTGACAACTACTA | 2 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 1668 | 2662 | CTTGCTGGTTGACAACTACT | 2 | NC | NC | NC |
| 1669 | 2663 | GCTTGCTGGTTGACAACTAC | 2 | NC | NC | NC |
| 1670 | 2664 | GGCTTGCTGGTTGACAACTA | 2 | NC | NC | NC |
| 1671 | 2665 | TGGCTTGCTGGTTGACAACT | 2 | NC | NC | NC |
| 1672 | 2666 | GTGGCTTGCTGGTTGACAAC | 2 | NC | NC | NC |
| 1673 | 2667 | TGTGGCTTGCTGGTTGACAA | 2 | NC | NC | NC |
| 1674 | 2668 | ATGTGGCTTGCTGGTTGACA | 2 | NC | NC | NC |
| 1675 | 2669 | GATGTGGCTTGCTGGTTGAC | 2 | NC | NC | NC |
| 1676 | 2670 | GGATGTGGCTTGCTGGTTGA | 2 | NC | NC | NC |
| 1677 | 2671 | AGGATGTGGCTTGCTGGTTG | 2 | NC | NC | NC |
| 1678 | 2672 | AAGGATGTGGCTTGCTGGTT | 2 | NC | NC | NC |
| 1679 | 2673 | TAAGGATGTGGCTTGCTGGT | 2 | NC | NC | NC |
| 1680 | 2674 | TTAAGGATGTGGCTTGCTGG | 2 | NC | NC | NC |
| 1681 | 2675 | GTTAAGGATGTGGCTTGCTG | 2 | NC | NC | NC |
| 1682 | 2676 | AGTTAAGGATGTGGCTTGCT | 2 | NC | NC | NC |
| 1683 | 2677 | GAGTTAAGGATGTGGCTTGC | 2 | NC | NC | NC |
| 1684 | 2678 | TGAGTTAAGGATGTGGCTTG | 2 | NC | NC | NC |
| 1685 | 2679 | CTGAGTTAAGGATGTGGCTT | 2 | NC | NC | NC |
| 1686 | 2680 | TCTGAGTTAAGGATGTGGCT | 2 | NC | NC | NC |
| 1687 | 2681 | CTCTGAGTTAAGGATGTGGC | 2 | NC | NC | NC |
| 1688 | 2682 | TCTCTGAGTTAAGGATGTGG | 2 | NC | NC | NC |
| 1689 | 2683 | TTCTCTGAGTTAAGGATGTG | 2 | NC | NC | NC |
| 1690 | 2684 | CTTCTCTGAGTTAAGGATGT | 2 | NC | NC | NC |
| 1691 | 2685 | ACTTCTCTGAGTTAAGGATG | 2 | NC | NC | NC |
| 1692 | 2686 | AACTTCTCTGAGTTAAGGAT | 2 | NC | NC | NC |
| 1693 | 2687 | AAACTTCTCTGAGTTAAGGA | 2 | NC | NC | NC |
| 1694 | 2688 | GAAACTTCTCTGAGTTAAGG | 2 | NC | NC | NC |
| 1695 | 2689 | GGAAACTTCTCTGAGTTAAG | 2 | NC | NC | NC |
| 1696 | 2690 | TGGAAACTTCTCTGAGTTAA | 2 | NC | NC | NC |
| 1697 | 2691 | ATGGAAACTTCTCTGAGTTA | 2 | NC | NC | NC |
| 1698 | 2693 | GAATGGAAACTTCTCTGAGT | 2 | NC | NC | NC |
| 1699 | 2694 | AGAATGGAAACTTCTCTGAG | 2 | NC | NC | NC |
| 1700 | 2699 | CTTGGAGAATGGAAACTTCT | 1 | NC | NC | NC |
| 1701 | 2700 | CCTTGGAGAATGGAAACTTC | 2 | NC | NC | NC |
| 1702 | 2701 | TCCTTGGAGAATGGAAACTT | 1 | NC | NC | NC |
| 1703 | 2702 | ATCCTTGGAGAATGGAAACT | 2 | NC | NC | NC |
| 1704 | 2703 | CATCCTTGGAGAATGGAAAC | 2 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 1705 | 2704 | TCATCCTTGGAGAATGGAAA | 1 | NC | NC | NC |
| 1706 | 2705 | TTCATCCTTGGAGAATGGAA | 2 | 2 | NC | NC |
| 1707 | 2706 | CTTCATCCTTGGAGAATGGA | 2 | 2 | NC | NC |
| 1708 | 2707 | TCTTCATCCTTGGAGAATGG | 2 | 2 | NC | NC |
| 1709 | 2708 | ATCTTCATCCTTGGAGAATG | 2 | 2 | NC | NC |
| 1710 | 2709 | AATCTTCATCCTTGGAGAAT | 2 | 2 | NC | NC |
| 1711 | 2710 | CAATCTTCATCCTTGGAGAA | 1 | 2 | NC | NC |
| 1712 | 2712 | AACAATCTTCATCCTTGGAG | 2 | 2 | NC | NC |
| 1713 | 2713 | AAACAATCTTCATCCTTGGA | 2 | 2 | NC | NC |
| 1714 | 2714 | TAAACAATCTTCATCCTTGG | 2 | 2 | NC | NC |
| 1715 | 2715 | CTAAACAATCTTCATCCTTG | 2 | 2 | NC | NC |
| 1716 | 2716 | TCTAAACAATCTTCATCCTT | 2 | 2 | NC | NC |
| 1717 | 2717 | TTCTAAACAATCTTCATCCT | 2 | 2 | NC | NC |
| 1718 | 2718 | GTTCTAAACAATCTTCATCC | 2 | 2 | NC | NC |
| 1719 | 2719 | TGTTCTAAACAATCTTCATC | 2 | 2 | NC | NC |
| 1720 | 2729 | AGGCATCTGTTGTTCTAAAC | 2 | 1 | NC | NC |
| 1721 | 2730 | TAGGCATCTGTTGTTCTAAA | 2 | 2 | NC | NC |
| 1722 | 2731 | CTAGGCATCTGTTGTTCTAA | 2 | 2 | NC | NC |
| 1723 | 2732 | ACTAGGCATCTGTTGTTCTA | 2 | 3 | NC | NC |
| 1724 | 2733 | AACTAGGCATCTGTTGTTCT | 2 | 2 | NC | NC |
| 1725 | 2734 | AAACTAGGCATCTGTTGTTC | 2 | 2 | NC | NC |
| 1726 | 2735 | CAAACTAGGCATCTGTTGTT | 2 | 1 | NC | NC |
| 1727 | 2736 | TCAAACTAGGCATCTGTTGT | 2 | 2 | NC | NC |
| 1728 | 2737 | CTCAAACTAGGCATCTGTTG | 2 | 3 | NC | NC |
| 1729 | 2738 | TCTCAAACTAGGCATCTGTT | 2 | 2 | NC | NC |
| 1730 | 2739 | CTCTCAAACTAGGCATCTGT | 1 | 2 | NC | NC |
| 1731 | 2740 | TCTCTCAAACTAGGCATCTG | 1 | 2 | NC | NC |
| 1732 | 2741 | TTCTCTCAAACTAGGCATCT | 1 | 2 | NC | NC |
| 1733 | 2742 | TTTCTCTCAAACTAGGCATC | 2 | 2 | NC | NC |
| 1734 | 2743 | CTTTCTCTCAAACTAGGCAT | 2 | 2 | NC | NC |
| 1735 | 2744 | ACTTTCTCTCAAACTAGGCA | 2 | NC | NC | NC |
| 1736 | 2745 | GACTTTCTCTCAAACTAGGC | 2 | NC | NC | NC |
| 1737 | 2746 | GGACTTTCTCTCAAACTAGG | 2 | NC | NC | NC |
| 1738 | 2747 | AGGACTTTCTCTCAAACTAG | 1 | NC | NC | NC |
| 1739 | 2748 | TAGGACTTTCTCTCAAACTA | 2 | NC | NC | NC |
| 1740 | 2749 | ATAGGACTTTCTCTCAAACT | 2 | NC | NC | NC |
| 1741 | 2750 | CATAGGACTTTCTCTCAAAC | 2 | NC | NC | NC |

TABLE 2-continued

| Exemplary Oligonucleotides | | | | | | |
|---|---|---|---|---|---|---|
| SEQ | | | Off-target Score | | | |
| ID NO | Position | Sequence | Human | Cyno | Mouse | Rat |
| 1742 | 2751 | TCATAGGACTTTCTCTCAAA | 2 | NC | NC | NC |
| 1743 | 2763 | ACTCCTTCAGGGTCATAGGA | 2 | NC | NC | NC |
| 1744 | 2764 | AACTCCTTCAGGGTCATAGG | 2 | 2 | NC | NC |
| 1745 | 2765 | TAACTCCTTCAGGGTCATAG | 2 | 2 | NC | NC |
| 1746 | 2766 | ATAACTCCTTCAGGGTCATA | 2 | 2 | NC | NC |
| 1747 | 2767 | GATAACTCCTTCAGGGTCAT | 2 | 2 | NC | NC |
| 1748 | 2768 | AGATAACTCCTTCAGGGTCA | 2 | 2 | NC | NC |
| 1749 | 2769 | GAGATAACTCCTTCAGGGTC | 2 | 2 | NC | NC |
| 1750 | 2780 | TCTATTAAAGAGAGATAACT | 1 | 1 | NC | NC |
| 1751 | 2781 | TTCTATTAAAGAGAGATAAC | 2 | 2 | NC | NC |
| 1752 | 2784 | GTTTTCTATTAAAGAGAGAT | 1 | 0 | NC | NC |
| 1753 | 2785 | GGTTTTCTATTAAAGAGAGA | 2 | 1 | NC | NC |
| 1754 | 2786 | AGGTTTTCTATTAAAGAGAG | 2 | 2 | NC | NC |
| 1755 | 2787 | AAGGTTTTCTATTAAAGAGA | 2 | 2 | NC | NC |
| 1756 | 2788 | AAAGGTTTTCTATTAAAGAG | 1 | 2 | NC | NC |
| 1757 | 2789 | CAAAGGTTTTCTATTAAAGA | 1 | 1 | NC | NC |
| 1758 | 2790 | CCAAAGGTTTTCTATTAAAG | 1 | 2 | NC | NC |
| 1759 | 2791 | TCCAAAGGTTTTCTATTAAA | 1 | 1 | NC | NC |
| 1760 | 2792 | GTCCAAAGGTTTTCTATTAA | 2 | 1 | NC | NC |
| 1761 | 2793 | GGTCCAAAGGTTTTCTATTA | 2 | 2 | NC | NC |
| 1762 | 2794 | AGGTCCAAAGGTTTTCTATT | 2 | 2 | NC | NC |
| 1763 | 2795 | AAGGTCCAAAGGTTTTCTAT | 2 | 2 | NC | NC |
| 1764 | 2796 | CAAGGTCCAAAGGTTTTCTA | 2 | 2 | NC | NC |
| 1765 | 2797 | TCAAGGTCCAAAGGTTTTCT | 2 | 2 | NC | NC |
| 1766 | 2798 | CTCAAGGTCCAAAGGTTTTC | 2 | 2 | NC | NC |
| 1767 | 2799 | TCTCAAGGTCCAAAGGTTTT | 2 | 1 | NC | NC |
| 1768 | 2800 | TTCTCAAGGTCCAAAGGTTT | 2 | 2 | NC | NC |
| 1769 | 2801 | CTTCTCAAGGTCCAAAGGTT | 2 | 2 | NC | NC |
| 1770 | 2802 | ACTTCTCAAGGTCCAAAGGT | 2 | 2 | NC | NC |
| 1771 | 2803 | GACTTCTCAAGGTCCAAAGG | 2 | 1 | NC | NC |
| 1772 | 2804 | TGACTTCTCAAGGTCCAAAG | 1 | 1 | NC | NC |
| 1773 | 2805 | ATGACTTCTCAAGGTCCAAA | 1 | 1 | NC | NC |
| 1774 | 2806 | GATGACTTCTCAAGGTCCAA | 1 | 2 | NC | NC |
| 1775 | 2807 | AGATGACTTCTCAAGGTCCA | 1 | 2 | NC | NC |
| 1776 | 2808 | CAGATGACTTCTCAAGGTCC | 1 | 2 | NC | NC |
| 1777 | 2809 | TCAGATGACTTCTCAAGGTC | 2 | 2 | NC | NC |
| 1778 | 2810 | TTCAGATGACTTCTCAAGGT | 1 | 2 | NC | NC |

TABLE 2-continued

| Exemplary Oligonucleotides | | | | | | |
|---|---|---|---|---|---|---|
| SEQ | | | Off-target Score | | | |
| ID NO | Position | Sequence | Human | Cyno | Mouse | Rat |
| 1779 | 2811 | ATTCAGATGACTTCTCAAGG | 1 | 2 | NC | NC |
| 1780 | 2812 | GATTCAGATGACTTCTCAAG | 2 | 2 | NC | NC |
| 1781 | 2813 | TGATTCAGATGACTTCTCAA | 2 | 2 | NC | NC |
| 1782 | 2814 | GTGATTCAGATGACTTCTCA | 2 | 2 | NC | NC |
| 1783 | 2815 | AGTGATTCAGATGACTTCTC | 2 | 2 | NC | NC |
| 1784 | 2816 | TAGTGATTCAGATGACTTCT | 2 | 2 | NC | NC |
| 1785 | 2817 | CTAGTGATTCAGATGACTTC | 2 | 2 | NC | NC |
| 1786 | 2818 | GCTAGTGATTCAGATGACTT | 2 | 2 | NC | NC |
| 1787 | 2819 | GGCTAGTGATTCAGATGACT | 3 | 2 | NC | NC |
| 1788 | 2820 | AGGCTAGTGATTCAGATGAC | 3 | 2 | NC | NC |
| 1789 | 2821 | GAGGCTAGTGATTCAGATGA | 3 | 2 | NC | NC |
| 1790 | 2822 | AGAGGCTAGTGATTCAGATG | 2 | 2 | NC | NC |
| 1791 | 2823 | TAGAGGCTAGTGATTCAGAT | 2 | 2 | NC | NC |
| 1792 | 2824 | TTAGAGGCTAGTGATTCAGA | 2 | 1 | NC | NC |
| 1793 | 2825 | TTTAGAGGCTAGTGATTCAG | 3 | 1 | NC | NC |
| 1794 | 2826 | ATTTAGAGGCTAGTGATTCA | 2 | 2 | NC | NC |
| 1795 | 2827 | AATTTAGAGGCTAGTGATTC | 2 | 2 | NC | NC |
| 1796 | 2828 | TAATTTAGAGGCTAGTGATT | 2 | 2 | NC | NC |
| 1797 | 2829 | ATAATTTAGAGGCTAGTGAT | 2 | 2 | NC | NC |
| 1798 | 2830 | GATAATTTAGAGGCTAGTGA | 2 | 2 | NC | NC |
| 1799 | 2831 | GGATAATTTAGAGGCTAGTG | 2 | 2 | NC | NC |
| 1800 | 2832 | TGGATAATTTAGAGGCTAGT | 3 | 3 | NC | NC |
| 1801 | 2833 | CTGGATAATTTAGAGGCTAG | 2 | 2 | NC | NC |
| 1802 | 2834 | TCTGGATAATTTAGAGGCTA | 2 | 2 | NC | NC |
| 1803 | 2835 | GTCTGGATAATTTAGAGGCT | 2 | 2 | NC | NC |
| 1804 | 2836 | AGTCTGGATAATTTAGAGGC | 2 | NC | NC | NC |
| 1805 | 2837 | CAGTCTGGATAATTTAGAGG | 2 | NC | NC | NC |
| 1806 | 2838 | TCAGTCTGGATAATTTAGAG | 2 | NC | NC | NC |
| 1807 | 2839 | TTCAGTCTGGATAATTTAGA | 2 | NC | NC | NC |
| 1808 | 2840 | CTTCAGTCTGGATAATTTAG | 2 | NC | NC | NC |
| 1809 | 2841 | CCTTCAGTCTGGATAATTTA | 2 | NC | NC | NC |
| 1810 | 2842 | CCCTTCAGTCTGGATAATTT | 2 | NC | NC | NC |
| 1811 | 2843 | ACCCTTCAGTCTGGATAATT | 2 | NC | NC | NC |
| 1812 | 2844 | AACCCTTCAGTCTGGATAAT | 2 | NC | NC | NC |
| 1813 | 2845 | GAACCCTTCAGTCTGGATAA | 2 | NC | NC | NC |
| 1814 | 2846 | GGAACCCTTCAGTCTGGATA | 3 | NC | NC | NC |
| 1815 | 2847 | CGGAACCCTTCAGTCTGGAT | 3 | NC | NC | NC |

TABLE 2-continued

| Exemplary Oligonucleotides | | | | | | |
|---|---|---|---|---|---|---|
| SEQ | | | Off-target Score | | | |
| ID NO | Position | Sequence | Human | Cyno | Mouse | Rat |
| 1816 | 2848 | TCGGAACCCTTCAGTCTGGA | 3 | NC | NC | NC |
| 1817 | 2849 | TTCGGAACCCTTCAGTCTGG | 3 | NC | NC | NC |
| 1818 | 2850 | TTTCGGAACCCTTCAGTCTG | 2 | NC | NC | NC |
| 1819 | 2851 | CTTTCGGAACCCTTCAGTCT | 2 | NC | NC | NC |
| 1820 | 2852 | TCTTTCGGAACCCTTCAGTC | 3 | NC | NC | NC |
| 1821 | 2853 | CTCTTTCGGAACCCTTCAGT | 3 | NC | NC | NC |
| 1822 | 2854 | TCTCTTTCGGAACCCTTCAG | 2 | NC | NC | NC |
| 1823 | 2855 | TTCTCTTTCGGAACCCTTCA | 2 | NC | NC | NC |
| 1824 | 2856 | TTTCTCTTTCGGAACCCTTC | 3 | 2 | NC | NC |
| 1825 | 2857 | GTTTCTCTTTCGGAACCCTT | 2 | 2 | NC | NC |
| 1826 | 2858 | AGTTTCTCTTTCGGAACCCT | 2 | 2 | NC | NC |
| 1827 | 2859 | GAGTTTCTCTTTCGGAACCC | 3 | 2 | NC | NC |
| 1828 | 2860 | TGAGTTTCTCTTTCGGAACC | 1 | 2 | NC | NC |
| 1829 | 2861 | TTGAGTTTCTCTTTCGGAAC | 2 | 2 | NC | NC |
| 1830 | 2862 | TTTGAGTTTCTCTTTCGGAA | 1 | 1 | NC | NC |
| 1831 | 2863 | GTTTGAGTTTCTCTTTCGGA | 2 | 2 | NC | NC |
| 1832 | 2864 | TGTTTGAGTTTCTCTTTCGG | 2 | 2 | NC | NC |
| 1833 | 2865 | TTGTTTGAGTTTCTCTTTCG | 1 | 2 | NC | NC |
| 1834 | 2866 | ATTGTTTGAGTTTCTCTTTC | 1 | 1 | NC | NC |
| 1835 | 2867 | CATTGTTTGAGTTTCTCTTT | 2 | 2 | NC | NC |
| 1836 | 2868 | CCATTGTTTGAGTTTCTCTT | 2 | 2 | NC | NC |
| 1837 | 2869 | CCCATTGTTTGAGTTTCTCT | 2 | NC | NC | NC |
| 1838 | 2870 | CCCCATTGTTTGAGTTTCTC | 2 | NC | NC | NC |
| 1839 | 2871 | TCCCCATTGTTTGAGTTTCT | 1 | NC | NC | NC |
| 1840 | 2872 | ATCCCCATTGTTTGAGTTTC | 2 | NC | NC | NC |
| 1841 | 2873 | CATCCCCATTGTTTGAGTTT | 2 | NC | NC | NC |
| 1842 | 2874 | TCATCCCCATTGTTTGAGTT | 1 | NC | NC | NC |
| 1843 | 2875 | ATCATCCCCATTGTTTGAGT | 2 | NC | NC | NC |
| 1844 | 2876 | CATCATCCCCATTGTTTGAG | 1 | NC | NC | NC |
| 1845 | 2877 | TCATCATCCCCATTGTTTGA | 2 | NC | NC | NC |
| 1846 | 2878 | CTCATCATCCCCATTGTTTG | 2 | NC | NC | NC |
| 1847 | 2879 | ACTCATCATCCCCATTGTTT | 2 | NC | NC | NC |
| 1848 | 2880 | GACTCATCATCCCCATTGTT | 2 | NC | NC | NC |
| 1849 | 2881 | CGACTCATCATCCCCATTGT | 2 | NC | NC | NC |
| 1850 | 2882 | ACGACTCATCATCCCCATTG | 1 | NC | NC | NC |
| 1851 | 2883 | AACGACTCATCATCCCCATT | 2 | NC | NC | NC |
| 1852 | 2884 | AAACGACTCATCATCCCCAT | 2 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 1853 | 2885 | AAAACGACTCATCATCCCCA | 2 | NC | NC | NC |
| 1854 | 2886 | TAAAACGACTCATCATCCCC | 2 | NC | NC | NC |
| 1855 | 2887 | TTAAAACGACTCATCATCCC | 1 | NC | NC | NC |
| 1856 | 2888 | ATTAAAACGACTCATCATCC | 0 | NC | NC | NC |
| 1857 | 2889 | CATTAAAACGACTCATCATC | 0 | 2 | NC | NC |
| 1858 | 2890 | TCATTAAAACGACTCATCAT | 1 | 2 | NC | NC |
| 1859 | 2891 | TTCATTAAAACGACTCATCA | 2 | 2 | NC | NC |
| 1860 | 2892 | GTTCATTAAAACGACTCATC | 2 | 2 | NC | NC |
| 1861 | 2893 | AGTTCATTAAAACGACTCAT | 2 | 2 | NC | NC |
| 1862 | 2894 | AAGTTCATTAAAACGACTCA | 2 | 2 | NC | NC |
| 1863 | 2895 | GAAGTTCATTAAAACGACTC | 2 | 3 | NC | NC |
| 1864 | 2896 | GGAAGTTCATTAAAACGACT | 2 | 2 | NC | NC |
| 1865 | 2897 | TGGAAGTTCATTAAAACGAC | 3 | 3 | NC | NC |
| 1866 | 2898 | TTGGAAGTTCATTAAAACGA | 2 | 2 | NC | NC |
| 1867 | 2899 | TTTGGAAGTTCATTAAAACG | 1 | 2 | NC | NC |
| 1868 | 2900 | ATTTGGAAGTTCATTAAAAC | 1 | 2 | NC | NC |
| 1869 | 2902 | GAATTTGGAAGTTCATTAAA | 2 | 2 | NC | NC |
| 1870 | 2903 | TGAATTTGGAAGTTCATTAA | 2 | 2 | NC | NC |
| 1871 | 2904 | CTGAATTTGGAAGTTCATTA | 2 | 2 | NC | NC |
| 1872 | 2905 | TCTGAATTTGGAAGTTCATT | 2 | 1 | NC | NC |
| 1873 | 2906 | ATCTGAATTTGGAAGTTCAT | 2 | 2 | NC | NC |
| 1874 | 2907 | AATCTGAATTTGGAAGTTCA | 2 | 2 | NC | NC |
| 1875 | 2908 | GAATCTGAATTTGGAAGTTC | 2 | 2 | NC | NC |
| 1876 | 2909 | GGAATCTGAATTTGGAAGTT | 2 | 2 | NC | NC |
| 1877 | 2910 | TGGAATCTGAATTTGGAAGT | 1 | 1 | NC | NC |
| 1878 | 2911 | CTGGAATCTGAATTTGGAAG | 2 | 2 | NC | NC |
| 1879 | 2912 | ACTGGAATCTGAATTTGGAA | 2 | 2 | NC | NC |
| 1880 | 2913 | TACTGGAATCTGAATTTGGA | 2 | 2 | NC | NC |
| 1881 | 2914 | CTACTGGAATCTGAATTTGG | 2 | 2 | NC | NC |
| 1882 | 2915 | CCTACTGGAATCTGAATTTG | 2 | 2 | NC | NC |
| 1883 | 2927 | CTTGCTGTCTTTCCTACTGG | 2 | NC | NC | NC |
| 1884 | 2928 | ACTTGCTGTCTTTCCTACTG | 2 | NC | NC | NC |
| 1885 | 2929 | AACTTGCTGTCTTTCCTACT | 2 | NC | NC | NC |
| 1886 | 2930 | CAACTTGCTGTCTTTCCTAC | 1 | NC | NC | NC |
| 1887 | 2931 | ACAACTTGCTGTCTTTCCTA | 1 | NC | NC | NC |
| 1888 | 2932 | CACAACTTGCTGTCTTTCCT | 2 | NC | NC | NC |
| 1889 | 2943 | TTAACACACTGCACAACTTG | 2 | 2 | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 1890 | 2944 | GTTAACACACTGCACAACTT | 1 | 2 | NC | NC |
| 1891 | 2945 | TGTTAACACACTGCACAACT | 1 | 2 | NC | NC |
| 1892 | 2957 | ACAAAAATCTTGTGTTAACA | 2 | 2 | NC | NC |
| 1893 | 2958 | TACAAAAATCTTGTGTTAAC | 2 | 2 | NC | NC |
| 1894 | 2960 | CATACAAAAATCTTGTGTTA | 2 | 1 | NC | NC |
| 1895 | 2961 | ACATACAAAAATCTTGTGTT | 2 | 1 | NC | NC |
| 1896 | 2962 | AACATACAAAAATCTTGTGT | 2 | 1 | NC | NC |
| 1897 | 2963 | TAACATACAAAAATCTTGTG | 1 | 2 | NC | NC |
| 1898 | 2980 | TCATGCTTGTTGTTAAATAA | 2 | NC | NC | NC |
| 1899 | 2981 | TTCATGCTTGTTGTTAAATA | 2 | NC | NC | NC |
| 1900 | 2982 | TTTCATGCTTGTTGTTAAAT | 1 | NC | NC | NC |
| 1901 | 2983 | TTTTCATGCTTGTTGTTAAA | 1 | NC | NC | NC |
| 1902 | 2984 | TTTTTCATGCTTGTTGTTAA | 1 | NC | NC | NC |
| 1903 | 3000 | TGACACCATTCTCTGTTTTT | 2 | 2 | NC | NC |
| 1904 | 3001 | ATGACACCATTCTCTGTTTT | 2 | 2 | NC | NC |
| 1905 | 3002 | GATGACACCATTCTCTGTTT | 2 | 2 | NC | NC |
| 1906 | 3003 | GGATGACACCATTCTCTGTT | 2 | 3 | NC | NC |
| 1907 | 3004 | GGGATGACACCATTCTCTGT | 2 | 2 | NC | NC |
| 1908 | 3005 | TGGGATGACACCATTCTCTG | 2 | 2 | NC | NC |
| 1909 | 3006 | TTGGGATGACACCATTCTCT | 1 | 1 | NC | NC |
| 1910 | 3007 | GTTGGGATGACACCATTCTC | 2 | 2 | NC | NC |
| 1911 | 3008 | TGTTGGGATGACACCATTCT | 2 | 2 | NC | NC |
| 1912 | 3009 | ATGTTGGGATGACACCATTC | 2 | 2 | NC | NC |
| 1913 | 3010 | GATGTTGGGATGACACCATT | 2 | 3 | NC | NC |
| 1914 | 3011 | TGATGTTGGGATGACACCAT | 2 | 2 | NC | NC |
| 1915 | 3012 | CTGATGTTGGGATGACACCA | 2 | 2 | NC | NC |
| 1916 | 3013 | TCTGATGTTGGGATGACACC | 2 | 2 | NC | NC |
| 1917 | 3014 | ATCTGATGTTGGGATGACAC | 2 | 2 | NC | NC |
| 1918 | 3015 | AATCTGATGTTGGGATGACA | 2 | 2 | NC | NC |
| 1919 | 3016 | GAATCTGATGTTGGGATGAC | 2 | 2 | NC | NC |
| 1920 | 3017 | AGAATCTGATGTTGGGATGA | 2 | 2 | NC | NC |
| 1921 | 3018 | CAGAATCTGATGTTGGGATG | 2 | 2 | NC | NC |
| 1922 | 3019 | GCAGAATCTGATGTTGGGAT | 2 | 2 | NC | NC |
| 1923 | 3020 | GGCAGAATCTGATGTTGGGA | 2 | 2 | NC | NC |
| 1924 | 3021 | TGGCAGAATCTGATGTTGGG | 2 | 1 | NC | NC |
| 1925 | 3022 | GTGGCAGAATCTGATGTTGG | 2 | 2 | NC | NC |
| 1926 | 3023 | TGTGGCAGAATCTGATGTTG | 2 | 2 | NC | NC |

TABLE 2-continued

| Exemplary Oligonucleotides | | | | | | |
|---|---|---|---|---|---|---|
| SEQ | | | Off-target Score | | | |
| ID NO | Position | Sequence | Human | Cyno | Mouse | Rat |
| 1927 | 3024 | GTGTGGCAGAATCTGATGTT | 2 | 2 | NC | NC |
| 1928 | 3025 | TGTGTGGCAGAATCTGATGT | 2 | 1 | NC | NC |
| 1929 | 3065 | GTTAGAATGTGTTTTACTAT | 1 | 1 | NC | NC |
| 1930 | 3066 | TGTTAGAATGTGTTTTACTA | 2 | 2 | NC | NC |
| 1931 | 3067 | CTGTTAGAATGTGTTTTACT | 2 | 2 | NC | NC |
| 1932 | 3068 | GCTGTTAGAATGTGTTTTAC | 2 | 2 | NC | NC |
| 1933 | 3069 | TGCTGTTAGAATGTGTTTTA | 2 | 1 | NC | NC |
| 1934 | 3070 | TTGCTGTTAGAATGTGTTTT | 2 | 2 | NC | NC |
| 1935 | 3071 | ATTGCTGTTAGAATGTGTTT | 2 | 2 | NC | NC |
| 1936 | 3072 | TATTGCTGTTAGAATGTGTT | 2 | 2 | NC | NC |
| 1937 | 3073 | GTATTGCTGTTAGAATGTGT | 2 | 2 | NC | NC |
| 1938 | 3074 | TGTATTGCTGTTAGAATGTG | 2 | 2 | NC | NC |
| 1939 | 3075 | TTGTATTGCTGTTAGAATGT | 2 | 2 | NC | NC |
| 1940 | 3076 | GTTGTATTGCTGTTAGAATG | 2 | 2 | NC | NC |
| 1941 | 3077 | TGTTGTATTGCTGTTAGAAT | 2 | 2 | NC | NC |
| 1942 | 3078 | CTGTTGTATTGCTGTTAGAA | 2 | 2 | NC | NC |
| 1943 | 3079 | TCTGTTGTATTGCTGTTAGA | 2 | 2 | NC | NC |
| 1944 | 3080 | CTCTGTTGTATTGCTGTTAG | 2 | 2 | NC | NC |
| 1945 | 3081 | TCTCTGTTGTATTGCTGTTA | 2 | 2 | NC | NC |
| 1946 | 3082 | TTCTCTGTTGTATTGCTGTT | 2 | 2 | NC | NC |
| 1947 | 3083 | GTTCTCTGTTGTATTGCTGT | 2 | 2 | NC | NC |
| 1948 | 3084 | AGTTCTCTGTTGTATTGCTG | 2 | 1 | NC | NC |
| 1949 | 3085 | CAGTTCTCTGTTGTATTGCT | 2 | 2 | NC | NC |
| 1950 | 3096 | CTGATATCACACAGTTCTCT | 2 | 2 | NC | NC |
| 1951 | 3097 | TCTGATATCACACAGTTCTC | 2 | 2 | NC | NC |
| 1952 | 3098 | TTCTGATATCACACAGTTCT | 2 | 1 | NC | NC |
| 1953 | 3099 | TTTCTGATATCACACAGTTC | 2 | 2 | NC | NC |
| 1954 | 3100 | GTTTCTGATATCACACAGTT | 2 | 2 | NC | NC |
| 1955 | 3101 | AGTTTCTGATATCACACAGT | 2 | 2 | NC | NC |
| 1956 | 3102 | GAGTTTCTGATATCACACAG | 2 | 2 | NC | NC |
| 1957 | 3103 | GGAGTTTCTGATATCACACA | 2 | 2 | NC | NC |
| 1958 | 3104 | AGGAGTTTCTGATATCACAC | 2 | 2 | NC | NC |
| 1959 | 3105 | AAGGAGTTTCTGATATCACA | 2 | 2 | NC | NC |
| 1960 | 3106 | AAAGGAGTTTCTGATATCAC | 2 | 2 | NC | NC |
| 1961 | 3107 | CAAAGGAGTTTCTGATATCA | 1 | 2 | NC | NC |
| 1962 | 3108 | CCAAAGGAGTTTCTGATATC | 1 | 2 | NC | NC |
| 1963 | 3109 | ACCAAAGGAGTTTCTGATAT | 2 | 2 | NC | NC |

TABLE 2-continued

| Exemplary Oligonucleotides | | | | | | |
|---|---|---|---|---|---|---|
| SEQ | | | Off-target Score | | | |
| ID NO | Position | Sequence | Human | Cyno | Mouse | Rat |
| 1964 | 3110 | TACCAAAGGAGTTTCTGATA | 2 | 2 | NC | NC |
| 1965 | 3111 | ATACCAAAGGAGTTTCTGAT | 2 | 2 | NC | NC |
| 1966 | 3112 | AATACCAAAGGAGTTTCTGA | 1 | 1 | NC | NC |
| 1967 | 3113 | CAATACCAAAGGAGTTTCTG | 1 | 1 | NC | NC |
| 1968 | 3114 | GCAATACCAAAGGAGTTTCT | 2 | 2 | NC | NC |
| 1969 | 3127 | GAATTATTATAGGGCAATAC | 2 | NC | NC | NC |
| 1970 | 3128 | AGAATTATTATAGGGCAATA | 2 | NC | NC | NC |
| 1971 | 3129 | TAGAATTATTATAGGGCAAT | 1 | NC | NC | NC |
| 1972 | 3130 | TTAGAATTATTATAGGGCAA | 1 | NC | NC | NC |
| 1973 | 3131 | TTTAGAATTATTATAGGGCA | 2 | NC | NC | NC |
| 1974 | 3132 | CTTTAGAATTATTATAGGGC | 2 | NC | NC | NC |
| 1975 | 3133 | ACTTTAGAATTATTATAGGG | 2 | NC | NC | NC |
| 1976 | 3138 | CGGTAACTTTAGAATTATTA | 2 | NC | NC | NC |
| 1977 | 3139 | CCGGTAACTTTAGAATTATT | 2 | NC | NC | NC |
| 1978 | 3140 | ACCGGTAACTTTAGAATTAT | 2 | NC | NC | NC |
| 1979 | 3141 | TACCGGTAACTTTAGAATTA | 2 | NC | NC | NC |
| 1980 | 3142 | TTACCGGTAACTTTAGAATT | 1 | NC | NC | NC |
| 1981 | 3143 | TTTACCGGTAACTTTAGAAT | 2 | NC | NC | NC |
| 1982 | 3144 | CTTTACCGGTAACTTTAGAA | 3 | NC | NC | NC |
| 1983 | 3145 | TCTTTACCGGTAACTTTAGA | 2 | NC | NC | NC |
| 1984 | 3146 | ATCTTTACCGGTAACTTTAG | 2 | NC | NC | NC |
| 1985 | 3147 | AATCTTTACCGGTAACTTTA | 2 | NC | NC | NC |
| 1986 | 3148 | GAATCTTTACCGGTAACTTT | 3 | NC | NC | NC |
| 1987 | 3149 | TGAATCTTTACCGGTAACTT | 2 | NC | NC | NC |
| 1988 | 3150 | CTGAATCTTTACCGGTAACT | 3 | NC | NC | NC |
| 1989 | 3151 | TCTGAATCTTTACCGGTAAC | 2 | NC | NC | NC |
| 1990 | 3152 | ATCTGAATCTTTACCGGTAA | 3 | NC | NC | NC |
| 1991 | 3153 | CATCTGAATCTTTACCGGTA | 3 | NC | NC | NC |
| 1992 | 3154 | ACATCTGAATCTTTACCGGT | 3 | NC | NC | NC |
| 1993 | 3155 | AACATCTGAATCTTTACCGG | 2 | NC | NC | NC |
| 1994 | 3156 | GAACATCTGAATCTTTACCG | 2 | NC | NC | NC |
| 1995 | 3157 | AGAACATCTGAATCTTTACC | 2 | NC | NC | NC |
| 1996 | 3158 | AAGAACATCTGAATCTTTAC | 2 | 2 | NC | NC |
| 1997 | 3159 | TAAGAACATCTGAATCTTTA | 2 | 2 | NC | NC |
| 1998 | 3160 | ATAAGAACATCTGAATCTTT | 1 | 2 | NC | NC |
| 1999 | 3161 | GATAAGAACATCTGAATCTT | 2 | 2 | NC | NC |
| 2000 | 3162 | TGATAAGAACATCTGAATCT | 1 | 2 | 2 | 1 |

TABLE 2-continued

Exemplary Oligonucleotides

| SEQ ID NO | Position | Sequence | Off-target Score Human | Cyno | Mouse | Rat |
|---|---|---|---|---|---|---|
| 2001 | 3163 | CTGATAAGAACATCTGAATC | 2 | 2 | 1 | 2 |
| 2002 | 3164 | TCTGATAAGAACATCTGAAT | 2 | 2 | 1 | 2 |
| 2003 | 3165 | CTCTGATAAGAACATCTGAA | 1 | 2 | NC | NC |
| 2004 | 3166 | GCTCTGATAAGAACATCTGA | 2 | 2 | NC | NC |
| 2005 | 3167 | GGCTCTGATAAGAACATCTG | 2 | NC | NC | NC |
| 2006 | 3168 | AGGCTCTGATAAGAACATCT | 2 | NC | NC | NC |
| 2007 | 3169 | GAGGCTCTGATAAGAACATC | 1 | NC | NC | NC |
| 2008 | 3170 | TGAGGCTCTGATAAGAACAT | 1 | NC | NC | NC |
| 2009 | 3171 | CTGAGGCTCTGATAAGAACA | 2 | NC | NC | NC |
| 2010 | 3172 | TCTGAGGCTCTGATAAGAAC | 2 | NC | NC | NC |
| 2011 | 3173 | TTCTGAGGCTCTGATAAGAA | 2 | NC | NC | NC |
| 2012 | 3174 | GTTCTGAGGCTCTGATAAGA | 1 | NC | NC | NC |
| 2013 | 3175 | TGTTCTGAGGCTCTGATAAG | 1 | NC | NC | NC |
| 2014 | 3176 | TTGTTCTGAGGCTCTGATAA | 1 | NC | NC | NC |
| 2015 | 3177 | GTTGTTCTGAGGCTCTGATA | 1 | NC | NC | NC |
| 2016 | 3178 | TGTTGTTCTGAGGCTCTGAT | 2 | NC | NC | NC |
| 2017 | 3179 | CTGTTGTTCTGAGGCTCTGA | 2 | NC | NC | NC |
| 2018 | 3180 | TCTGTTGTTCTGAGGCTCTG | 2 | NC | NC | NC |
| 2019 | 3181 | ATCTGTTGTTCTGAGGCTCT | 2 | NC | NC | NC |
| 2020 | 3182 | TATCTGTTGTTCTGAGGCTC | 1 | NC | NC | NC |
| 2021 | 3183 | CTATCTGTTGTTCTGAGGCT | 1 | NC | NC | NC |
| 2022 | 3184 | CCTATCTGTTGTTCTGAGGC | 2 | NC | NC | NC |
| 2023 | 3185 | TCCTATCTGTTGTTCTGAGG | 2 | NC | NC | NC |
| 2024 | 3186 | TTCCTATCTGTTGTTCTGAG | 1 | NC | NC | NC |
| 2025 | 3187 | CTTCCTATCTGTTGTTCTGA | 2 | NC | NC | NC |
| 2026 | 3188 | ACTTCCTATCTGTTGTTCTG | 2 | NC | NC | NC |
| 2027 | 3189 | GACTTCCTATCTGTTGTTCT | 2 | NC | NC | NC |
| 2028 | 3190 | AGACTTCCTATCTGTTGTTC | 2 | NC | NC | NC |
| 2029 | 3191 | AAGACTTCCTATCTGTTGTT | 2 | NC | NC | NC |
| 2030 | 3192 | CAAGACTTCCTATCTGTTGT | 2 | NC | NC | NC |
| 2031 | 3193 | TCAAGACTTCCTATCTGTTG | 2 | NC | NC | NC |
| 2032 | 3194 | GTCAAGACTTCCTATCTGTT | 2 | NC | NC | NC |
| 2033 | 3195 | AGTCAAGACTTCCTATCTGT | 2 | NC | NC | NC |
| 2034 | 3206 | TCCACTGGGAGAGTCAAGAC | 2 | NC | NC | NC |
| 2035 | 3217 | TTCATTAACATTCCACTGGG | 2 | 2 | NC | NC |
| 2036 | 3218 | ATTCATTAACATTCCACTGG | 1 | 2 | NC | NC |
| 2037 | 3219 | GATTCATTAACATTCCACTG | 1 | 1 | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 2038 | 3220 | GGATTCATTAACATTCCACT | 2 | NC | NC | NC |
| 2039 | 3221 | CGGATTCATTAACATTCCAC | 2 | NC | NC | NC |
| 2040 | 3222 | CCGGATTCATTAACATTCCA | 3 | NC | NC | NC |
| 2041 | 3223 | ACCGGATTCATTAACATTCC | 2 | NC | NC | NC |
| 2042 | 3224 | TACCGGATTCATTAACATTC | 3 | NC | NC | NC |
| 2043 | 3225 | CTACCGGATTCATTAACATT | 3 | NC | NC | NC |
| 2044 | 3226 | TCTACCGGATTCATTAACAT | 3 | NC | NC | NC |
| 2045 | 3227 | TTCTACCGGATTCATTAACA | 2 | NC | NC | NC |
| 2046 | 3228 | CTTCTACCGGATTCATTAAC | 3 | NC | NC | NC |
| 2047 | 3229 | TCTTCTACCGGATTCATTAA | 2 | NC | NC | NC |
| 2048 | 3230 | ATCTTCTACCGGATTCATTA | 2 | NC | NC | NC |
| 2049 | 3231 | CATCTTCTACCGGATTCATT | 2 | NC | NC | NC |
| 2050 | 3232 | GCATCTTCTACCGGATTCAT | 2 | NC | NC | NC |
| 2051 | 3233 | GGCATCTTCTACCGGATTCA | 2 | NC | NC | NC |
| 2052 | 3234 | TGGCATCTTCTACCGGATTC | 2 | NC | NC | NC |
| 2053 | 3235 | GTGGCATCTTCTACCGGATT | 2 | NC | NC | NC |
| 2054 | 3236 | TGTGGCATCTTCTACCGGAT | 2 | NC | NC | NC |
| 2055 | 3237 | CTGTGGCATCTTCTACCGGA | 2 | NC | NC | NC |
| 2056 | 3239 | ACCTGTGGCATCTTCTACCG | 2 | NC | NC | NC |
| 2057 | 3240 | CACCTGTGGCATCTTCTACC | 2 | NC | NC | NC |
| 2058 | 3241 | TCACCTGTGGCATCTTCTAC | 2 | NC | NC | NC |
| 2059 | 3242 | GTCACCTGTGGCATCTTCTA | 2 | NC | NC | NC |
| 2060 | 3243 | GGTCACCTGTGGCATCTTCT | 1 | NC | NC | NC |
| 2061 | 3244 | TGGTCACCTGTGGCATCTTC | 1 | NC | NC | NC |
| 2062 | 3245 | TTGGTCACCTGTGGCATCTT | 2 | NC | NC | NC |
| 2063 | 3246 | TTTGGTCACCTGTGGCATCT | 2 | NC | NC | NC |
| 2064 | 3247 | TTTTGGTCACCTGTGGCATC | 2 | 2 | NC | NC |
| 2065 | 3248 | ATTTTGGTCACCTGTGGCAT | 2 | 2 | NC | NC |
| 2066 | 3249 | CATTTTGGTCACCTGTGGCA | 2 | 2 | NC | NC |
| 2067 | 3250 | CCATTTTGGTCACCTGTGGC | 2 | 3 | NC | NC |
| 2068 | 3263 | CTGAAAACAAATTCCATTTT | 1 | NC | NC | NC |
| 2069 | 3264 | TCTGAAAACAAATTCCATTT | 1 | NC | NC | NC |
| 2070 | 3265 | CTCTGAAAACAAATTCCATT | 1 | NC | NC | NC |
| 2071 | 3266 | ACTCTGAAAACAAATTCCAT | 2 | NC | NC | NC |
| 2072 | 3267 | CACTCTGAAAACAAATTCCA | 1 | NC | NC | NC |
| 2073 | 3268 | TCACTCTGAAAACAAATTCC | 2 | NC | NC | NC |
| 2074 | 3269 | CTCACTCTGAAAACAAATTC | 2 | NC | NC | NC |

TABLE 2-continued

| Exemplary Oligonucleotides | | | | | | |
|---|---|---|---|---|---|---|
| SEQ | | | Off-target Score | | | |
| ID NO | Position | Sequence | Human | Cyno | Mouse | Rat |
| 2075 | 3270 | CCTCACTCTGAAAACAAATT | 2 | NC | NC | NC |
| 2076 | 3271 | TCCTCACTCTGAAAACAAAT | 2 | NC | NC | NC |
| 2077 | 3272 | TTCCTCACTCTGAAAACAAA | 2 | NC | NC | NC |
| 2078 | 3273 | ATTCCTCACTCTGAAAACAA | 2 | NC | NC | NC |
| 2079 | 3274 | GATTCCTCACTCTGAAAACA | 2 | NC | NC | NC |
| 2080 | 3275 | AGATTCCTCACTCTGAAAAC | 2 | NC | NC | NC |
| 2081 | 3276 | TAGATTCCTCACTCTGAAAA | 2 | NC | NC | NC |
| 2082 | 3277 | TTAGATTCCTCACTCTGAAA | 2 | NC | NC | NC |
| 2083 | 3278 | TTTAGATTCCTCACTCTGAA | 2 | NC | NC | NC |
| 2084 | 3279 | CTTTAGATTCCTCACTCTGA | 2 | NC | NC | NC |
| 2085 | 3280 | GCTTTAGATTCCTCACTCTG | 1 | NC | NC | NC |
| 2086 | 3281 | TGCTTTAGATTCCTCACTCT | 2 | NC | NC | NC |
| 2087 | 3282 | TTGCTTTAGATTCCTCACTC | 2 | NC | NC | NC |
| 2088 | 3283 | CTTGCTTTAGATTCCTCACT | 1 | 2 | NC | NC |
| 2089 | 3284 | TCTTGCTTTAGATTCCTCAC | 1 | 2 | NC | NC |
| 2090 | 3285 | CTCTTGCTTTAGATTCCTCA | 2 | 1 | NC | NC |
| 2091 | 3286 | GCTCTTGCTTTAGATTCCTC | 2 | 2 | NC | NC |
| 2092 | 3300 | CAGTTTCAGAACAAGCTCTT | 2 | 2 | NC | NC |
| 2093 | 3301 | TCAGTTTCAGAACAAGCTCT | 2 | 1 | NC | NC |
| 2094 | 3302 | TTCAGTTTCAGAACAAGCTC | 2 | 2 | NC | NC |
| 2095 | 3303 | CTTCAGTTTCAGAACAAGCT | 2 | 2 | NC | NC |
| 2096 | 3304 | TCTTCAGTTTCAGAACAAGC | 1 | 2 | NC | NC |
| 2097 | 3305 | CTCTTCAGTTTCAGAACAAG | 1 | 1 | NC | NC |
| 2098 | 3306 | ACTCTTCAGTTTCAGAACAA | 2 | 2 | NC | NC |
| 2099 | 3307 | GACTCTTCAGTTTCAGAACA | 2 | 2 | NC | NC |
| 2100 | 3308 | TGACTCTTCAGTTTCAGAAC | 2 | 2 | NC | NC |
| 2101 | 3309 | TTGACTCTTCAGTTTCAGAA | 2 | 2 | NC | NC |
| 2102 | 3310 | TTTGACTCTTCAGTTTCAGA | 2 | 2 | NC | NC |
| 2103 | 3311 | GTTTGACTCTTCAGTTTCAG | 2 | 2 | NC | NC |
| 2104 | 3312 | TGTTTGACTCTTCAGTTTCA | 2 | 2 | NC | NC |
| 2105 | 3313 | GTGTTTGACTCTTCAGTTTC | 2 | 2 | NC | NC |
| 2106 | 3314 | CGTGTTTGACTCTTCAGTTT | 2 | 2 | NC | NC |
| 2107 | 3315 | ACGTGTTTGACTCTTCAGTT | 2 | 2 | NC | NC |
| 2108 | 3316 | CACGTGTTTGACTCTTCAGT | 2 | 2 | NC | NC |
| 2109 | 3317 | ACACGTGTTTGACTCTTCAG | 2 | 2 | NC | NC |
| 2110 | 3318 | AACACGTGTTTGACTCTTCA | 3 | 2 | NC | NC |
| 2111 | 3330 | GCCAATCTGAACAACACGTG | 2 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 2112 | 3331 | TGCCAATCTGAACAACACGT | 2 | NC | NC | NC |
| 2113 | 3332 | CTGCCAATCTGAACAACACG | 2 | NC | NC | NC |
| 2114 | 3333 | GCTGCCAATCTGAACAACAC | 1 | NC | NC | NC |
| 2115 | 3334 | CGCTGCCAATCTGAACAACA | 2 | NC | NC | NC |
| 2116 | 3335 | CCGCTGCCAATCTGAACAAC | 2 | NC | NC | NC |
| 2117 | 3336 | GCCGCTGCCAATCTGAACAA | 2 | NC | NC | NC |
| 2118 | 3337 | TGCCGCTGCCAATCTGAACA | 2 | NC | NC | NC |
| 2119 | 3338 | ATGCCGCTGCCAATCTGAAC | 2 | NC | NC | NC |
| 2120 | 3339 | AATGCCGCTGCCAATCTGAA | 1 | NC | NC | NC |
| 2121 | 3340 | AAATGCCGCTGCCAATCTGA | 1 | NC | NC | NC |
| 2122 | 3341 | GAAATGCCGCTGCCAATCTG | 2 | NC | NC | NC |
| 2123 | 3342 | CGAAATGCCGCTGCCAATCT | 2 | NC | NC | NC |
| 2124 | 3343 | TCGAAATGCCGCTGCCAATC | 2 | NC | NC | NC |
| 2125 | 3344 | ATCGAAATGCCGCTGCCAAT | 2 | NC | NC | NC |
| 2126 | 3345 | CATCGAAATGCCGCTGCCAA | 3 | NC | NC | NC |
| 2127 | 3346 | ACATCGAAATGCCGCTGCCA | 2 | NC | NC | NC |
| 2128 | 3347 | TACATCGAAATGCCGCTGCC | 3 | NC | NC | NC |
| 2129 | 3348 | CTACATCGAAATGCCGCTGC | 3 | NC | NC | NC |
| 2130 | 3349 | GCTACATCGAAATGCCGCTG | 3 | NC | NC | NC |
| 2131 | 3350 | GGCTACATCGAAATGCCGCT | 3 | NC | NC | NC |
| 2132 | 3354 | CCAGGGCTACATCGAAATGC | 3 | 2 | NC | NC |
| 2133 | 3356 | TCCCAGGGCTACATCGAAAT | 3 | NC | NC | NC |
| 2134 | 3357 | TTCCCAGGGCTACATCGAAA | 2 | NC | NC | NC |
| 2135 | 3358 | CTTCCCAGGGCTACATCGAA | 2 | NC | NC | NC |
| 2136 | 3359 | TCTTCCCAGGGCTACATCGA | 2 | NC | NC | NC |
| 2137 | 3360 | TTCTTCCCAGGGCTACATCG | 2 | NC | NC | NC |
| 2138 | 3361 | ATTCTTCCCAGGGCTACATC | 2 | NC | NC | NC |
| 2139 | 3362 | CATTCTTCCCAGGGCTACAT | 1 | NC | NC | NC |
| 2140 | 3363 | CCATTCTTCCCAGGGCTACA | 1 | NC | NC | NC |
| 2141 | 3364 | ACCATTCTTCCCAGGGCTAC | 1 | NC | NC | NC |
| 2142 | 3365 | AACCATTCTTCCCAGGGCTA | 2 | NC | NC | NC |
| 2143 | 3366 | AAACCATTCTTCCCAGGGCT | 2 | NC | NC | NC |
| 2144 | 3367 | TAAACCATTCTTCCCAGGGC | 2 | NC | NC | NC |
| 2145 | 3368 | ATAAACCATTCTTCCCAGGG | 2 | NC | NC | NC |
| 2146 | 3369 | CATAAACCATTCTTCCCAGG | 2 | NC | NC | NC |
| 2147 | 3370 | ACATAAACCATTCTTCCCAG | 2 | NC | NC | NC |
| 2148 | 3371 | GACATAAACCATTCTTCCCA | 2 | NC | NC | NC |

TABLE 2-continued

| Exemplary Oligonucleotides | | | | | | |
|---|---|---|---|---|---|---|
| SEQ | | | Off-target Score | | | |
| ID NO | Position | Sequence | Human | Cyno | Mouse | Rat |
| 2149 | 3372 | TGACATAAACCATTCTTCCC | 2 | NC | NC | NC |
| 2150 | 3373 | TTGACATAAACCATTCTTCC | 2 | NC | NC | NC |
| 2151 | 3374 | GTTGACATAAACCATTCTTC | 2 | NC | NC | NC |
| 2152 | 3375 | TGTTGACATAAACCATTCTT | 2 | NC | NC | NC |
| 2153 | 3376 | TTGTTGACATAAACCATTCT | 2 | 2 | NC | NC |
| 2154 | 3377 | TTTGTTGACATAAACCATTC | 2 | 2 | NC | NC |
| 2155 | 3378 | TTTTGTTGACATAAACCATT | 2 | 2 | NC | NC |
| 2156 | 3379 | ATTTTGTTGACATAAACCAT | 2 | 2 | NC | NC |
| 2157 | 3380 | CATTTTGTTGACATAAACCA | 2 | 2 | NC | NC |
| 2158 | 3381 | TCATTTTGTTGACATAAACC | 2 | 2 | NC | NC |
| 2159 | 3389 | GAGTCCAGTCATTTTGTTGA | 2 | 2 | NC | NC |
| 2160 | 3390 | TGAGTCCAGTCATTTTGTTG | 2 | 3 | NC | NC |
| 2161 | 3391 | CTGAGTCCAGTCATTTTGTT | 1 | 2 | NC | NC |
| 2162 | 3402 | CAATGAATGTGCTGAGTCCA | 2 | 2 | NC | NC |
| 2163 | 3429 | AAGCAGCCTGAATGTCCTCA | 2 | 2 | NC | NC |
| 2164 | 3430 | CAAGCAGCCTGAATGTCCTC | 1 | 1 | NC | NC |
| 2165 | 3431 | ACAAGCAGCCTGAATGTCCT | 2 | 2 | NC | NC |
| 2166 | 3432 | TACAAGCAGCCTGAATGTCC | 2 | 1 | NC | NC |
| 2167 | 3433 | GTACAAGCAGCCTGAATGTC | 2 | 2 | NC | NC |
| 2168 | 3434 | AGTACAAGCAGCCTGAATGT | 2 | 2 | NC | NC |
| 2169 | 3435 | TAGTACAAGCAGCCTGAATG | 3 | 2 | NC | NC |
| 2170 | 3436 | TTAGTACAAGCAGCCTGAAT | 2 | 2 | NC | NC |
| 2171 | 3437 | TTTAGTACAAGCAGCCTGAA | 2 | 2 | NC | NC |
| 2172 | 3438 | CTTTAGTACAAGCAGCCTGA | 2 | 3 | NC | NC |
| 2173 | 3439 | TCTTTAGTACAAGCAGCCTG | 2 | 2 | NC | NC |
| 2174 | 3440 | GTCTTTAGTACAAGCAGCCT | 2 | 2 | NC | NC |
| 2175 | 3441 | GGTCTTTAGTACAAGCAGCC | 3 | 2 | NC | NC |
| 2176 | 3442 | AGGTCTTTAGTACAAGCAGC | 3 | 2 | NC | NC |
| 2177 | 3443 | CAGGTCTTTAGTACAAGCAG | 2 | 2 | NC | NC |
| 2178 | 3444 | TCAGGTCTTTAGTACAAGCA | 3 | 2 | NC | NC |
| 2179 | 3445 | GTCAGGTCTTTAGTACAAGC | 2 | 2 | NC | NC |
| 2180 | 3446 | TGTCAGGTCTTTAGTACAAG | 1 | 2 | NC | NC |
| 2181 | 3447 | TTGTCAGGTCTTTAGTACAA | 2 | 2 | NC | NC |
| 2182 | 3448 | GTTGTCAGGTCTTTAGTACA | 1 | 3 | NC | NC |
| 2183 | 3449 | AGTTGTCAGGTCTTTAGTAC | 2 | 3 | NC | NC |
| 2184 | 3450 | CAGTTGTCAGGTCTTTAGTA | 2 | 2 | NC | NC |
| 2185 | 3451 | ACAGTTGTCAGGTCTTTAGT | 2 | 2 | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 2186 | 3452 | CACAGTTGTCAGGTCTTTAG | 2 | 2 | NC | NC |
| 2187 | 3453 | CCACAGTTGTCAGGTCTTTA | 2 | 3 | NC | NC |
| 2188 | 3454 | GCCACAGTTGTCAGGTCTTT | 2 | 2 | NC | NC |
| 2189 | 3455 | AGCCACAGTTGTCAGGTCTT | 2 | 2 | NC | NC |
| 2190 | 3456 | CAGCCACAGTTGTCAGGTCT | 2 | 2 | NC | NC |
| 2191 | 3457 | ACAGCCACAGTTGTCAGGTC | 2 | 2 | NC | NC |
| 2192 | 3458 | CACAGCCACAGTTGTCAGGT | 2 | 2 | NC | NC |
| 2193 | 3460 | TCCACAGCCACAGTTGTCAG | 2 | 1 | 2 | NC |
| 2194 | 3461 | ATCCACAGCCACAGTTGTCA | 2 | 1 | 1 | NC |
| 2195 | 3462 | CATCCACAGCCACAGTTGTC | 2 | 1 | 2 | NC |
| 2196 | 3463 | ACATCCACAGCCACAGTTGT | 2 | 2 | 1 | NC |
| 2197 | 3464 | AACATCCACAGCCACAGTTG | 1 | NC | NC | NC |
| 2198 | 3465 | CAACATCCACAGCCACAGTT | 2 | NC | NC | NC |
| 2199 | 3466 | ACAACATCCACAGCCACAGT | 2 | NC | NC | NC |
| 2200 | 3467 | TACAACATCCACAGCCACAG | 2 | NC | NC | NC |
| 2201 | 3468 | GTACAACATCCACAGCCACA | 2 | NC | NC | NC |
| 2202 | 3469 | AGTACAACATCCACAGCCAC | 2 | NC | NC | NC |
| 2203 | 3470 | AAGTACAACATCCACAGCCA | 2 | NC | NC | NC |
| 2204 | 3471 | CAAGTACAACATCCACAGCC | 2 | NC | NC | NC |
| 2205 | 3472 | TCAAGTACAACATCCACAGC | 1 | NC | NC | NC |
| 2206 | 3473 | CTCAAGTACAACATCCACAG | 2 | NC | NC | NC |
| 2207 | 3474 | TCTCAAGTACAACATCCACA | 2 | NC | NC | NC |
| 2208 | 3475 | TTCTCAAGTACAACATCCAC | 2 | NC | NC | NC |
| 2209 | 3476 | ATTCTCAAGTACAACATCCA | 2 | NC | NC | NC |
| 2210 | 3477 | CATTCTCAAGTACAACATCC | 2 | NC | NC | NC |
| 2211 | 3478 | CCATTCTCAAGTACAACATC | 2 | NC | NC | NC |
| 2212 | 3479 | CCCATTCTCAAGTACAACAT | 2 | NC | NC | NC |
| 2213 | 3480 | ACCCATTCTCAAGTACAACA | 2 | NC | NC | NC |
| 2214 | 3481 | GACCCATTCTCAAGTACAAC | 2 | NC | NC | NC |
| 2215 | 3482 | AGACCCATTCTCAAGTACAA | 2 | NC | NC | NC |
| 2216 | 3491 | CCTGTACTGAGACCCATTCT | 2 | 2 | NC | NC |
| 2217 | 3492 | ACCTGTACTGAGACCCATTC | 2 | 2 | NC | NC |
| 2218 | 3493 | CACCTGTACTGAGACCCATT | 3 | 2 | NC | NC |
| 2219 | 3494 | ACACCTGTACTGAGACCCAT | 2 | 3 | NC | NC |
| 2220 | 3495 | GACACCTGTACTGAGACCCA | 2 | 2 | NC | NC |
| 2221 | 3496 | TGACACCTGTACTGAGACCC | 2 | 2 | NC | NC |
| 2222 | 3497 | TTGACACCTGTACTGAGACC | 2 | NC | NC | NC |

TABLE 2-continued

| Exemplary Oligonucleotides | | | | | | |
|---|---|---|---|---|---|---|
| SEQ | | | Off-target Score | | | |
| ID NO | Position | Sequence | Human | Cyno | Mouse | Rat |
| 2223 | 3498 | GTTGACACCTGTACTGAGAC | 2 | NC | NC | NC |
| 2224 | 3510 | CGCTTCTAAAAGGTTGACAC | 3 | NC | NC | NC |
| 2225 | 3511 | TCGCTTCTAAAAGGTTGACA | 2 | NC | NC | NC |
| 2226 | 3512 | GTCGCTTCTAAAAGGTTGAC | 3 | NC | NC | NC |
| 2227 | 3513 | GGTCGCTTCTAAAAGGTTGA | 3 | NC | NC | NC |
| 2228 | 3514 | AGGTCGCTTCTAAAAGGTTG | 2 | NC | NC | NC |
| 2229 | 3515 | AAGGTCGCTTCTAAAAGGTT | 2 | NC | NC | NC |
| 2230 | 3516 | CAAGGTCGCTTCTAAAAGGT | 2 | NC | NC | NC |
| 2231 | 3517 | ACAAGGTCGCTTCTAAAAGG | 3 | 3 | NC | NC |
| 2232 | 3518 | AACAAGGTCGCTTCTAAAAG | 2 | 2 | NC | NC |
| 2233 | 3519 | GAACAAGGTCGCTTCTAAAA | 2 | 1 | NC | NC |
| 2234 | 3520 | AGAACAAGGTCGCTTCTAAA | 2 | 2 | NC | NC |
| 2235 | 3521 | AAGAACAAGGTCGCTTCTAA | 2 | 2 | NC | NC |
| 2236 | 3522 | GAAGAACAAGGTCGCTTCTA | 2 | 3 | NC | NC |
| 2237 | 3523 | GGAAGAACAAGGTCGCTTCT | 2 | 2 | NC | NC |
| 2238 | 3524 | AGGAAGAACAAGGTCGCTTC | 2 | 2 | NC | NC |
| 2239 | 3525 | AAGGAAGAACAAGGTCGCTT | 2 | 2 | NC | NC |
| 2240 | 3526 | AAAGGAAGAACAAGGTCGCT | 2 | 2 | NC | NC |
| 2241 | 3527 | GAAAGGAAGAACAAGGTCGC | 2 | 2 | NC | NC |
| 2242 | 3528 | GGAAAGGAAGAACAAGGTCG | 2 | 2 | NC | NC |
| 2243 | 3529 | AGGAAAGGAAGAACAAGGTC | 2 | 2 | NC | NC |
| 2244 | 3530 | AAGGAAAGGAAGAACAAGGT | 1 | 2 | NC | NC |
| 2245 | 3531 | GAAGGAAAGGAAGAACAAGG | 1 | 1 | NC | NC |
| 2246 | 3532 | GGAAGGAAAGGAAGAACAAG | 1 | 1 | NC | NC |
| 2247 | 3533 | CGGAAGGAAAGGAAGAACAA | 2 | 1 | NC | NC |
| 2248 | 3534 | TCGGAAGGAAAGGAAGAACA | 2 | 2 | NC | NC |
| 2249 | 3535 | CTCGGAAGGAAAGGAAGAAC | 2 | 1 | NC | NC |
| 2250 | 3536 | TCTCGGAAGGAAAGGAAGAA | 2 | 1 | NC | NC |
| 2251 | 3537 | CTCTCGGAAGGAAAGGAAGA | 2 | 2 | NC | NC |
| 2252 | 3538 | GCTCTCGGAAGGAAAGGAAG | 2 | 2 | NC | NC |
| 2253 | 3539 | AGCTCTCGGAAGGAAAGGAA | 1 | 2 | NC | NC |
| 2254 | 3540 | GAGCTCTCGGAAGGAAAGGA | 1 | 2 | NC | NC |
| 2255 | 3564 | GTCTCATCACAGTCCTCTCT | 2 | 2 | NC | NC |
| 2256 | 3565 | TGTCTCATCACAGTCCTCTC | 2 | 2 | NC | NC |
| 2257 | 3573 | TGTTATCCTGTCTCATCACA | 2 | 2 | NC | NC |
| 2258 | 3574 | CTGTTATCCTGTCTCATCAC | 1 | 2 | NC | NC |
| 2259 | 3575 | TCTGTTATCCTGTCTCATCA | 1 | 2 | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 2260 | 3576 | CTCTGTTATCCTGTCTCATC | 2 | 2 | NC | NC |
| 2261 | 3577 | TCTCTGTTATCCTGTCTCAT | 2 | 2 | NC | NC |
| 2262 | 3578 | ATCTCTGTTATCCTGTCTCA | 1 | 2 | NC | NC |
| 2263 | 3579 | TATCTCTGTTATCCTGTCTC | 1 | 1 | NC | NC |
| 2264 | 3580 | GTATCTCTGTTATCCTGTCT | 1 | 1 | NC | NC |
| 2265 | 3581 | AGTATCTCTGTTATCCTGTC | 2 | 2 | NC | NC |
| 2266 | 3592 | GTATCATCCACAGTATCTCT | 2 | 2 | NC | NC |
| 2267 | 3593 | AGTATCATCCACAGTATCTC | 2 | NC | NC | NC |
| 2268 | 3594 | CAGTATCATCCACAGTATCT | 1 | NC | NC | NC |
| 2269 | 3595 | ACAGTATCATCCACAGTATC | 1 | NC | NC | NC |
| 2270 | 3596 | AACAGTATCATCCACAGTAT | 2 | NC | NC | NC |
| 2271 | 3597 | TAACAGTATCATCCACAGTA | 2 | NC | NC | NC |
| 2272 | 3598 | CTAACAGTATCATCCACAGT | 2 | NC | NC | NC |
| 2273 | 3599 | ACTAACAGTATCATCCACAG | 2 | NC | NC | NC |
| 2274 | 3600 | TACTAACAGTATCATCCACA | 2 | NC | NC | NC |
| 2275 | 3601 | CTACTAACAGTATCATCCAC | 2 | NC | NC | NC |
| 2276 | 3602 | GCTACTAACAGTATCATCCA | 2 | NC | NC | NC |
| 2277 | 3603 | CGCTACTAACAGTATCATCC | 3 | NC | NC | NC |
| 2278 | 3604 | TCGCTACTAACAGTATCATC | 2 | NC | NC | NC |
| 2279 | 3605 | TTCGCTACTAACAGTATCAT | 2 | NC | NC | NC |
| 2280 | 3606 | ATTCGCTACTAACAGTATCA | 3 | NC | NC | NC |
| 2281 | 3607 | GATTCGCTACTAACAGTATC | 3 | NC | NC | NC |
| 2282 | 3608 | CGATTCGCTACTAACAGTAT | 3 | NC | NC | NC |
| 2283 | 3621 | ACAAAGACTGAAGCGATTCG | 3 | NC | NC | NC |
| 2284 | 3622 | AACAAAGACTGAAGCGATTC | 2 | NC | NC | NC |
| 2285 | 3623 | GAACAAAGACTGAAGCGATT | 3 | NC | NC | NC |
| 2286 | 3624 | AGAACAAAGACTGAAGCGAT | 2 | NC | NC | NC |
| 2287 | 3625 | GAGAACAAAGACTGAAGCGA | 2 | NC | NC | NC |
| 2288 | 3626 | TGAGAACAAAGACTGAAGCG | 1 | NC | NC | NC |
| 2289 | 3627 | CTGAGAACAAAGACTGAAGC | 0 | 0 | NC | NC |
| 2290 | 3628 | TCTGAGAACAAAGACTGAAG | 1 | 1 | NC | NC |
| 2291 | 3629 | TTCTGAGAACAAAGACTGAA | 1 | 1 | NC | NC |
| 2292 | 3630 | ATTCTGAGAACAAAGACTGA | 2 | 2 | NC | NC |
| 2293 | 3631 | CATTCTGAGAACAAAGACTG | 2 | 2 | NC | NC |
| 2294 | 3632 | CCATTCTGAGAACAAAGACT | 2 | 2 | NC | NC |
| 2295 | 3633 | CCCATTCTGAGAACAAAGAC | 1 | 1 | NC | NC |
| 2296 | 3634 | TCCCATTCTGAGAACAAAGA | 1 | 1 | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 2297 | 3635 | GTCCCATTCTGAGAACAAAG | 2 | 1 | NC | NC |
| 2298 | 3636 | TGTCCCATTCTGAGAACAAA | 2 | 1 | NC | NC |
| 2299 | 3637 | TTGTCCCATTCTGAGAACAA | 2 | 1 | NC | NC |
| 2300 | 3638 | ATTGTCCCATTCTGAGAACA | 2 | 2 | NC | NC |
| 2301 | 3639 | GATTGTCCCATTCTGAGAAC | 3 | 2 | NC | NC |
| 2302 | 3640 | GGATTGTCCCATTCTGAGAA | 2 | 2 | NC | NC |
| 2303 | 3641 | TGGATTGTCCCATTCTGAGA | 2 | 2 | NC | NC |
| 2304 | 3642 | CTGGATTGTCCCATTCTGAG | 2 | 2 | NC | NC |
| 2305 | 3643 | ACTGGATTGTCCCATTCTGA | 2 | 2 | NC | NC |
| 2306 | 3644 | TACTGGATTGTCCCATTCTG | 2 | 2 | NC | NC |
| 2307 | 3645 | ATACTGGATTGTCCCATTCT | 2 | 2 | NC | NC |
| 2308 | 3646 | AATACTGGATTGTCCCATTC | 2 | 2 | NC | NC |
| 2309 | 3647 | AAATACTGGATTGTCCCATT | 1 | 2 | NC | NC |
| 2310 | 3648 | CAAATACTGGATTGTCCCAT | 2 | 2 | NC | NC |
| 2311 | 3649 | GCAAATACTGGATTGTCCCA | 2 | 2 | NC | NC |
| 2312 | 3650 | GGCAAATACTGGATTGTCCC | 2 | 2 | NC | NC |
| 2313 | 3652 | CGGGCAAATACTGGATTGTC | 3 | 3 | NC | NC |
| 2314 | 3653 | ACGGGCAAATACTGGATTGT | 2 | 2 | NC | NC |
| 2315 | 3654 | AACGGGCAAATACTGGATTG | 2 | 2 | NC | NC |
| 2316 | 3655 | TAACGGGCAAATACTGGATT | 3 | 2 | NC | NC |
| 2317 | 3656 | ATAACGGGCAAATACTGGAT | 2 | 2 | NC | NC |
| 2318 | 3657 | GATAACGGGCAAATACTGGA | 2 | 3 | NC | NC |
| 2319 | 3658 | GGATAACGGGCAAATACTGG | 3 | 3 | NC | NC |
| 2320 | 3659 | TGGATAACGGGCAAATACTG | 2 | 2 | NC | NC |
| 2321 | 3660 | CTGGATAACGGGCAAATACT | 3 | 2 | NC | NC |
| 2322 | 3661 | TCTGGATAACGGGCAAATAC | 2 | 3 | NC | NC |
| 2323 | 3662 | CTCTGGATAACGGGCAAATA | 3 | 2 | NC | NC |
| 2324 | 3663 | CCTCTGGATAACGGGCAAAT | 2 | 3 | NC | NC |
| 2325 | 3664 | ACCTCTGGATAACGGGCAAA | 3 | 2 | NC | NC |
| 2326 | 3665 | AACCTCTGGATAACGGGCAA | 2 | 3 | NC | NC |
| 2327 | 3666 | CAACCTCTGGATAACGGGCA | 2 | 2 | NC | NC |
| 2328 | 3668 | AGCAACCTCTGGATAACGGG | 2 | 2 | NC | NC |
| 2329 | 3669 | CAGCAACCTCTGGATAACGG | 2 | 2 | NC | NC |
| 2330 | 3678 | TTACATCAACAGCAACCTCT | 2 | 2 | NC | NC |
| 2331 | 3679 | CTTACATCAACAGCAACCTC | 2 | 2 | NC | NC |
| 2332 | 3680 | GCTTACATCAACAGCAACCT | 2 | 2 | NC | NC |
| 2333 | 3685 | CCACTGCTTACATCAACAGC | 2 | 2 | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 2334 | 3686 | GCCACTGCTTACATCAACAG | 2 | 2 | NC | NC |
| 2335 | 3710 | TTTAACTGCTAAGCTCTCAG | 2 | 2 | NC | NC |
| 2336 | 3711 | TTTTAACTGCTAAGCTCTCA | 2 | 2 | NC | NC |
| 2337 | 3712 | ATTTTAACTGCTAAGCTCTC | 2 | 2 | NC | NC |
| 2338 | 3713 | AATTTTAACTGCTAAGCTCT | 2 | 2 | NC | NC |
| 2339 | 3714 | GAATTTTAACTGCTAAGCTC | 2 | 2 | NC | NC |
| 2340 | 3715 | TGAATTTTAACTGCTAAGCT | 2 | 2 | NC | NC |
| 2341 | 3716 | GTGAATTTTAACTGCTAAGC | 1 | 1 | NC | NC |
| 2342 | 3717 | TGTGAATTTTAACTGCTAAG | 2 | 1 | NC | NC |
| 2343 | 3718 | TTGTGAATTTTAACTGCTAA | 2 | 1 | NC | NC |
| 2344 | 3719 | GTTGTGAATTTTAACTGCTA | 2 | 2 | NC | NC |
| 2345 | 3720 | TGTTGTGAATTTTAACTGCT | 2 | 1 | NC | NC |
| 2346 | 3721 | ATGTTGTGAATTTTAACTGC | 2 | 2 | NC | NC |
| 2347 | 3722 | GATGTTGTGAATTTTAACTG | 2 | 2 | NC | NC |
| 2348 | 3723 | AGATGTTGTGAATTTTAACT | 2 | 1 | NC | NC |
| 2349 | 3724 | AAGATGTTGTGAATTTTAAC | 2 | 1 | NC | NC |
| 2350 | 3725 | CAAGATGTTGTGAATTTTAA | 1 | 1 | NC | NC |
| 2351 | 3743 | GGTGAAACGATAGGGATACA | 2 | 3 | NC | NC |
| 2352 | 3744 | TGGTGAAACGATAGGGATAC | 3 | 3 | NC | NC |
| 2353 | 3745 | TTGGTGAAACGATAGGGATA | 3 | 2 | NC | NC |
| 2354 | 3746 | TTTGGTGAAACGATAGGGAT | 3 | 2 | NC | NC |
| 2355 | 3747 | CTTTGGTGAAACGATAGGGA | 3 | 2 | NC | NC |
| 2356 | 3748 | CCTTTGGTGAAACGATAGGG | 2 | NC | NC | NC |
| 2357 | 3750 | TTCCTTTGGTGAAACGATAG | 1 | NC | NC | NC |
| 2358 | 3751 | ATTCCTTTGGTGAAACGATA | 2 | NC | NC | NC |
| 2359 | 3752 | CATTCCTTTGGTGAAACGAT | 2 | NC | NC | NC |
| 2360 | 3753 | TCATTCCTTTGGTGAAACGA | 2 | NC | NC | NC |
| 2361 | 3754 | ATCATTCCTTTGGTGAAACG | 3 | NC | NC | NC |
| 2362 | 3755 | AATCATTCCTTTGGTGAAAC | 2 | NC | NC | NC |
| 2363 | 3756 | GAATCATTCCTTTGGTGAAA | 2 | NC | NC | NC |
| 2364 | 3757 | TGAATCATTCCTTTGGTGAA | 2 | NC | NC | NC |
| 2365 | 3758 | ATGAATCATTCCTTTGGTGA | 2 | NC | NC | NC |
| 2366 | 3759 | AATGAATCATTCCTTTGGTG | 2 | NC | NC | NC |
| 2367 | 3768 | CCTGCATTGAATGAATCATT | 1 | 2 | NC | NC |
| 2368 | 3769 | ACCTGCATTGAATGAATCAT | 2 | 2 | NC | NC |
| 2369 | 3770 | AACCTGCATTGAATGAATCA | 1 | 2 | NC | NC |
| 2370 | 3771 | GAACCTGCATTGAATGAATC | 2 | 2 | NC | NC |

TABLE 2-continued

| Exemplary Oligonucleotides | | | | | | |
|---|---|---|---|---|---|---|
| SEQ | | | Off-target Score | | | |
| ID NO | Position | Sequence | Human | Cyno | Mouse | Rat |
| 2371 | 3772 | AGAACCTGCATTGAATGAAT | 2 | 2 | NC | NC |
| 2372 | 3773 | GAGAACCTGCATTGAATGAA | 2 | 2 | NC | NC |
| 2373 | 3774 | GGAGAACCTGCATTGAATGA | 2 | 2 | NC | NC |
| 2374 | 3786 | TATCTACTTGCTGGAGAACC | 2 | NC | NC | NC |
| 2375 | 3787 | TTATCTACTTGCTGGAGAAC | 2 | NC | NC | NC |
| 2376 | 3788 | GTTATCTACTTGCTGGAGAA | 2 | NC | NC | NC |
| 2377 | 3789 | TGTTATCTACTTGCTGGAGA | 2 | NC | NC | NC |
| 2378 | 3790 | TTGTTATCTACTTGCTGGAG | 2 | NC | NC | NC |
| 2379 | 3791 | CTTGTTATCTACTTGCTGGA | 2 | NC | NC | NC |
| 2380 | 3792 | ACTTGTTATCTACTTGCTGG | 2 | NC | NC | NC |
| 2381 | 3793 | AACTTGTTATCTACTTGCTG | 2 | NC | NC | NC |
| 2382 | 3794 | AAACTTGTTATCTACTTGCT | 2 | NC | NC | NC |
| 2383 | 3795 | TAAACTTGTTATCTACTTGC | 2 | NC | NC | NC |
| 2384 | 3796 | ATAAACTTGTTATCTACTTG | 2 | NC | NC | NC |
| 2385 | 3798 | CAATAAACTTGTTATCTACT | 2 | NC | NC | NC |
| 2386 | 3799 | GCAATAAACTTGTTATCTAC | 2 | NC | NC | NC |
| 2387 | 3800 | GGCAATAAACTTGTTATCTA | 2 | NC | NC | NC |
| 2388 | 3801 | AGGCAATAAACTTGTTATCT | 2 | NC | NC | NC |
| 2389 | 3802 | CAGGCAATAAACTTGTTATC | 1 | NC | NC | NC |
| 2390 | 3803 | ACAGGCAATAAACTTGTTAT | 2 | NC | NC | NC |
| 2391 | 3804 | AACAGGCAATAAACTTGTTA | 2 | NC | NC | NC |
| 2392 | 3805 | AAACAGGCAATAAACTTGTT | 2 | NC | NC | NC |
| 2393 | 3806 | CAAACAGGCAATAAACTTGT | 1 | NC | NC | NC |
| 2394 | 3807 | TCAAACAGGCAATAAACTTG | 2 | 2 | NC | NC |
| 2395 | 3808 | ATCAAACAGGCAATAAACTT | 2 | 2 | NC | NC |
| 2396 | 3809 | CATCAAACAGGCAATAAACT | 1 | 1 | NC | NC |
| 2397 | 3810 | TCATCAAACAGGCAATAAAC | 2 | 2 | NC | NC |
| 2398 | 3811 | CTCATCAAACAGGCAATAAA | 2 | 2 | NC | NC |
| 2399 | 3812 | GCTCATCAAACAGGCAATAA | 2 | 2 | NC | NC |
| 2400 | 3813 | TGCTCATCAAACAGGCAATA | 2 | 2 | NC | NC |
| 2401 | 3814 | GTGCTCATCAAACAGGCAAT | 2 | 2 | NC | NC |
| 2402 | 3815 | AGTGCTCATCAAACAGGCAA | 2 | 2 | NC | NC |
| 2403 | 3816 | TAGTGCTCATCAAACAGGCA | 2 | 3 | NC | NC |
| 2404 | 3817 | TTAGTGCTCATCAAACAGGC | 2 | 3 | NC | NC |
| 2405 | 3818 | CTTAGTGCTCATCAAACAGG | 2 | 2 | NC | NC |
| 2406 | 3819 | TCTTAGTGCTCATCAAACAG | 2 | 2 | NC | NC |
| 2407 | 3820 | GTCTTAGTGCTCATCAAACA | 2 | 2 | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 2408 | 3821 | AGTCTTAGTGCTCATCAAAC | 2 | 2 | NC | NC |
| 2409 | 3822 | CAGTCTTAGTGCTCATCAAA | 2 | 2 | NC | NC |
| 2410 | 3823 | TCAGTCTTAGTGCTCATCAA | 2 | 2 | NC | NC |
| 2411 | 3824 | TTCAGTCTTAGTGCTCATCA | 2 | 2 | NC | NC |
| 2412 | 3825 | CTTCAGTCTTAGTGCTCATC | 2 | 2 | NC | NC |
| 2413 | 3826 | TCTTCAGTCTTAGTGCTCAT | 2 | 2 | NC | NC |
| 2414 | 3827 | CTCTTCAGTCTTAGTGCTCA | 2 | 2 | NC | NC |
| 2415 | 3828 | TCTCTTCAGTCTTAGTGCTC | 2 | 2 | NC | NC |
| 2416 | 3829 | TTCTCTTCAGTCTTAGTGCT | 2 | 2 | NC | NC |
| 2417 | 3830 | ATTCTCTTCAGTCTTAGTGC | 2 | 2 | NC | NC |
| 2418 | 3831 | CATTCTCTTCAGTCTTAGTG | 2 | 2 | NC | NC |
| 2419 | 3832 | CCATTCTCTTCAGTCTTAGT | 2 | 2 | NC | NC |
| 2420 | 3833 | GCCATTCTCTTCAGTCTTAG | 2 | 2 | NC | NC |
| 2421 | 3834 | CGCCATTCTCTTCAGTCTTA | 2 | 2 | NC | NC |
| 2422 | 3835 | TCGCCATTCTCTTCAGTCTT | 2 | 2 | NC | NC |
| 2423 | 3836 | CTCGCCATTCTCTTCAGTCT | 2 | 2 | NC | NC |
| 2424 | 3837 | CCTCGCCATTCTCTTCAGTC | 2 | 2 | NC | NC |
| 2425 | 3838 | GCCTCGCCATTCTCTTCAGT | 2 | 2 | NC | NC |
| 2426 | 3839 | TGCCTCGCCATTCTCTTCAG | 2 | 2 | NC | NC |
| 2427 | 3840 | CTGCCTCGCCATTCTCTTCA | 2 | 1 | NC | NC |
| 2428 | 3842 | ACCTGCCTCGCCATTCTCTT | 1 | 2 | NC | NC |
| 2429 | 3904 | AGCTGCTCCAGACGTATACG | 3 | NC | NC | NC |
| 2430 | 3905 | AAGCTGCTCCAGACGTATAC | 3 | NC | NC | NC |
| 2431 | 3906 | TAAGCTGCTCCAGACGTATA | 3 | NC | NC | NC |
| 2432 | 3907 | ATAAGCTGCTCCAGACGTAT | 3 | NC | NC | NC |
| 2433 | 3908 | GATAAGCTGCTCCAGACGTA | 3 | NC | NC | NC |
| 2434 | 3909 | TGATAAGCTGCTCCAGACGT | 2 | NC | NC | NC |
| 2435 | 3910 | ATGATAAGCTGCTCCAGACG | 2 | 3 | NC | NC |
| 2436 | 3911 | AATGATAAGCTGCTCCAGAC | 2 | 2 | NC | NC |
| 2437 | 3912 | CAATGATAAGCTGCTCCAGA | 2 | 2 | NC | NC |
| 2438 | 3913 | TCAATGATAAGCTGCTCCAG | 1 | 2 | NC | NC |
| 2439 | 3914 | ATCAATGATAAGCTGCTCCA | 1 | 2 | NC | NC |
| 2440 | 3915 | AATCAATGATAAGCTGCTCC | 2 | 2 | NC | NC |
| 2441 | 3916 | GAATCAATGATAAGCTGCTC | 2 | 3 | NC | NC |
| 2442 | 3917 | GGAATCAATGATAAGCTGCT | 2 | 2 | NC | NC |
| 2443 | 3918 | AGGAATCAATGATAAGCTGC | 2 | 2 | NC | NC |
| 2444 | 3919 | TAGGAATCAATGATAAGCTG | 2 | 2 | NC | NC |

TABLE 2-continued

| Exemplary Oligonucleotides | | | | | | |
|---|---|---|---|---|---|---|
| SEQ | | | Off-target Score | | | |
| ID NO | Position | Sequence | Human | Cyno | Mouse | Rat |
| 2445 | 3920 | GTAGGAATCAATGATAAGCT | 3 | NC | NC | NC |
| 2446 | 3921 | CGTAGGAATCAATGATAAGC | 3 | NC | NC | NC |
| 2447 | 3922 | TCGTAGGAATCAATGATAAG | 2 | NC | NC | NC |
| 2448 | 3923 | CTCGTAGGAATCAATGATAA | 2 | NC | NC | NC |
| 2449 | 3924 | TCTCGTAGGAATCAATGATA | 2 | NC | NC | NC |
| 2450 | 3925 | TTCTCGTAGGAATCAATGAT | 2 | NC | NC | NC |
| 2451 | 3926 | CTTCTCGTAGGAATCAATGA | 2 | NC | NC | NC |
| 2452 | 3927 | GCTTCTCGTAGGAATCAATG | 2 | NC | NC | NC |
| 2453 | 3928 | TGCTTCTCGTAGGAATCAAT | 2 | NC | NC | NC |
| 2454 | 3929 | TTGCTTCTCGTAGGAATCAA | 2 | NC | NC | NC |
| 2455 | 3930 | GTTGCTTCTCGTAGGAATCA | 2 | NC | NC | NC |
| 2456 | 3931 | TGTTGCTTCTCGTAGGAATC | 2 | NC | NC | NC |
| 2457 | 3932 | CTGTTGCTTCTCGTAGGAAT | 2 | NC | NC | NC |
| 2458 | 3933 | CCTGTTGCTTCTCGTAGGAA | 2 | NC | NC | NC |
| 2459 | 3934 | GCCTGTTGCTTCTCGTAGGA | 3 | NC | NC | NC |
| 2460 | 3953 | TTTCCGACCAGAGCCTTGTG | 2 | 3 | NC | NC |
| 2461 | 3954 | TTTTCCGACCAGAGCCTTGT | 2 | 3 | NC | NC |
| 2462 | 3955 | TTTTTCCGACCAGAGCCTTG | 2 | 2 | NC | NC |
| 2463 | 3971 | AGTAGAAGACAGTAATTTTT | 1 | 2 | NC | NC |
| 2464 | 3972 | GAGTAGAAGACAGTAATTTT | 2 | 2 | NC | NC |
| 2465 | 3973 | AGAGTAGAAGACAGTAATTT | 1 | 1 | NC | NC |
| 2466 | 3974 | TAGAGTAGAAGACAGTAATT | 2 | 2 | NC | NC |
| 2467 | 3975 | TTAGAGTAGAAGACAGTAAT | 2 | 2 | NC | NC |
| 2468 | 3976 | ATTAGAGTAGAAGACAGTAA | 2 | 2 | NC | NC |
| 2469 | 3977 | AATTAGAGTAGAAGACAGTA | 1 | 2 | NC | NC |
| 2470 | 3978 | GAATTAGAGTAGAAGACAGT | 2 | 2 | NC | NC |
| 2471 | 3979 | GGAATTAGAGTAGAAGACAG | 1 | 1 | NC | NC |
| 2472 | 3980 | AGGAATTAGAGTAGAAGACA | 1 | 1 | NC | NC |
| 2473 | 3981 | GAGGAATTAGAGTAGAAGAC | 2 | 2 | NC | NC |
| 2474 | 3982 | GGAGGAATTAGAGTAGAAGA | 1 | 2 | NC | NC |
| 2475 | 3983 | CGGAGGAATTAGAGTAGAAG | 2 | NC | NC | NC |
| 2476 | 3984 | GCGGAGGAATTAGAGTAGAA | 2 | NC | NC | NC |
| 2477 | 3985 | AGCGGAGGAATTAGAGTAGA | 2 | NC | NC | NC |
| 2478 | 3986 | TAGCGGAGGAATTAGAGTAG | 3 | NC | NC | NC |
| 2479 | 3987 | CTAGCGGAGGAATTAGAGTA | 2 | NC | NC | NC |
| 2480 | 3988 | TCTAGCGGAGGAATTAGAGT | 3 | NC | NC | NC |
| 2481 | 3999 | TCACTGTTATCTCTAGCGGA | 3 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 2482 | 4000 | GTCACTGTTATCTCTAGCGG | 3 | NC | NC | NC |
| 2483 | 4001 | TGTCACTGTTATCTCTAGCG | 3 | NC | NC | NC |
| 2484 | 4002 | CTGTCACTGTTATCTCTAGC | 2 | NC | NC | NC |
| 2485 | 4003 | TCTGTCACTGTTATCTCTAG | 1 | 2 | NC | NC |
| 2486 | 4004 | CTCTGTCACTGTTATCTCTA | 1 | 1 | NC | NC |
| 2487 | 4005 | CCTCTGTCACTGTTATCTCT | 1 | 2 | NC | NC |
| 2488 | 4006 | TCCTCTGTCACTGTTATCTC | 1 | 1 | NC | NC |
| 2489 | 4007 | TTCCTCTGTCACTGTTATCT | 2 | 2 | NC | NC |
| 2490 | 4008 | GTTCCTCTGTCACTGTTATC | 2 | 2 | NC | NC |
| 2491 | 4009 | TGTTCCTCTGTCACTGTTAT | 2 | 2 | NC | NC |
| 2492 | 4010 | TTGTTCCTCTGTCACTGTTA | 2 | 2 | NC | NC |
| 2493 | 4011 | TTTGTTCCTCTGTCACTGTT | 1 | 1 | NC | NC |
| 2494 | 4012 | CTTTGTTCCTCTGTCACTGT | 1 | 1 | NC | NC |
| 2495 | 4013 | CCTTTGTTCCTCTGTCACTG | 2 | 2 | NC | NC |
| 2496 | 4014 | TCCTTTGTTCCTCTGTCACT | 1 | 1 | NC | NC |
| 2497 | 4015 | CTCCTTTGTTCCTCTGTCAC | 2 | 2 | NC | NC |
| 2498 | 4016 | TCTCCTTTGTTCCTCTGTCA | 2 | 2 | NC | NC |
| 2499 | 4017 | GTCTCCTTTGTTCCTCTGTC | 2 | 1 | NC | NC |
| 2500 | 4018 | AGTCTCCTTTGTTCCTCTGT | 2 | 2 | NC | NC |
| 2501 | 4019 | GAGTCTCCTTTGTTCCTCTG | 1 | NC | NC | NC |
| 2502 | 4020 | AGAGTCTCCTTTGTTCCTCT | 2 | NC | NC | NC |
| 2503 | 4021 | AAGAGTCTCCTTTGTTCCTC | 1 | NC | NC | NC |
| 2504 | 4022 | TAAGAGTCTCCTTTGTTCCT | 2 | NC | NC | NC |
| 2505 | 4023 | ATAAGAGTCTCCTTTGTTCC | 1 | NC | NC | NC |
| 2506 | 4024 | CATAAGAGTCTCCTTTGTTC | 1 | NC | NC | NC |
| 2507 | 4025 | CCATAAGAGTCTCCTTTGTT | 1 | NC | NC | NC |
| 2508 | 4026 | ACCATAAGAGTCTCCTTTGT | 2 | NC | NC | NC |
| 2509 | 4027 | CACCATAAGAGTCTCCTTTG | 2 | NC | NC | NC |
| 2510 | 4028 | ACACCATAAGAGTCTCCTTT | 2 | NC | NC | NC |
| 2511 | 4029 | AACACCATAAGAGTCTCCTT | 2 | NC | NC | NC |
| 2512 | 4030 | TAACACCATAAGAGTCTCCT | 3 | NC | NC | NC |
| 2513 | 4031 | GTAACACCATAAGAGTCTCC | 3 | NC | NC | NC |
| 2514 | 4032 | GGTAACACCATAAGAGTCTC | 3 | NC | NC | NC |
| 2515 | 4046 | TTCCAGATTTTTGTGGTAAC | 2 | 2 | NC | NC |
| 2516 | 4047 | CTTCCAGATTTTTGTGGTAA | 2 | 2 | NC | NC |
| 2517 | 4048 | TCTTCCAGATTTTTGTGGTA | 1 | 2 | NC | NC |
| 2518 | 4049 | ATCTTCCAGATTTTTGTGGT | 2 | 1 | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 2519 | 4050 | GATCTTCCAGATTTTTGTGG | 2 | 2 | NC | NC |
| 2520 | 4051 | AGATCTTCCAGATTTTTGTG | 2 | 1 | NC | NC |
| 2521 | 4052 | CAGATCTTCCAGATTTTTGT | 2 | 1 | NC | NC |
| 2522 | 4053 | CCAGATCTTCCAGATTTTTG | 2 | 1 | NC | NC |
| 2523 | 4054 | CCCAGATCTTCCAGATTTTT | 1 | 1 | NC | NC |
| 2524 | 4055 | GCCCAGATCTTCCAGATTTT | 2 | 2 | NC | NC |
| 2525 | 4056 | GGCCCAGATCTTCCAGATTT | 2 | 3 | NC | NC |
| 2526 | 4057 | AGGCCCAGATCTTCCAGATT | 2 | 2 | NC | NC |
| 2527 | 4058 | AAGGCCCAGATCTTCCAGAT | 2 | 1 | NC | NC |
| 2528 | 4059 | CAAGGCCCAGATCTTCCAGA | 2 | 2 | NC | NC |
| 2529 | 4060 | TCAAGGCCCAGATCTTCCAG | 2 | 2 | NC | NC |
| 2530 | 4061 | TTCAAGGCCCAGATCTTCCA | 2 | 2 | NC | NC |
| 2531 | 4062 | ATTCAAGGCCCAGATCTTCC | 2 | NC | NC | NC |
| 2532 | 4063 | AATTCAAGGCCCAGATCTTC | 2 | NC | NC | NC |
| 2533 | 4064 | AAATTCAAGGCCCAGATCTT | 1 | NC | NC | NC |
| 2534 | 4065 | CAAATTCAAGGCCCAGATCT | 1 | NC | NC | NC |
| 2535 | 4066 | ACAAATTCAAGGCCCAGATC | 0 | NC | NC | NC |
| 2536 | 4067 | TACAAATTCAAGGCCCAGAT | 1 | NC | NC | NC |
| 2537 | 4068 | ATACAAATTCAAGGCCCAGA | 2 | NC | NC | NC |
| 2538 | 4069 | AATACAAATTCAAGGCCCAG | 2 | NC | NC | NC |
| 2539 | 4070 | AAATACAAATTCAAGGCCCA | 2 | NC | NC | NC |
| 2540 | 4071 | GAAATACAAATTCAAGGCCC | 1 | NC | NC | NC |
| 2541 | 4072 | GGAAATACAAATTCAAGGCC | 2 | NC | NC | NC |
| 2542 | 4073 | TGGAAATACAAATTCAAGGC | 1 | NC | NC | NC |
| 2543 | 4074 | CTGGAAATACAAATTCAAGG | 1 | NC | NC | NC |
| 2544 | 4075 | TCTGGAAATACAAATTCAAG | 1 | NC | NC | NC |
| 2545 | 4076 | GTCTGGAAATACAAATTCAA | 1 | NC | NC | NC |
| 2546 | 4077 | TGTCTGGAAATACAAATTCA | 1 | NC | NC | NC |
| 2547 | 4078 | GTGTCTGGAAATACAAATTC | 2 | NC | NC | NC |
| 2548 | 4079 | AGTGTCTGGAAATACAAATT | 2 | NC | NC | NC |
| 2549 | 4080 | TAGTGTCTGGAAATACAAAT | 2 | NC | NC | NC |
| 2550 | 4081 | CTAGTGTCTGGAAATACAAA | 2 | NC | NC | NC |
| 2551 | 4082 | ACTAGTGTCTGGAAATACAA | 2 | 2 | NC | NC |
| 2552 | 4083 | CACTAGTGTCTGGAAATACA | 2 | 2 | NC | NC |
| 2553 | 4084 | TCACTAGTGTCTGGAAATAC | 2 | 2 | NC | NC |
| 2554 | 4085 | ATCACTAGTGTCTGGAAATA | 2 | 2 | NC | NC |
| 2555 | 4086 | AATCACTAGTGTCTGGAAAT | 1 | 2 | NC | NC |

TABLE 2-continued

| Exemplary Oligonucleotides | | | | | | |
|---|---|---|---|---|---|---|
| SEQ | | | Off-target Score | | | |
| ID NO | Position | Sequence | Human | Cyno | Mouse | Rat |
| 2556 | 4087 | GAATCACTAGTGTCTGGAAA | 2 | 2 | NC | NC |
| 2557 | 4088 | AGAATCACTAGTGTCTGGAA | 2 | 2 | NC | NC |
| 2558 | 4089 | GAGAATCACTAGTGTCTGGA | 2 | 2 | NC | NC |
| 2559 | 4090 | AGAGAATCACTAGTGTCTGG | 2 | 2 | NC | NC |
| 2560 | 4091 | CAGAGAATCACTAGTGTCTG | 2 | 2 | NC | NC |
| 2561 | 4092 | CCAGAGAATCACTAGTGTCT | 2 | 2 | NC | NC |
| 2562 | 4093 | ACCAGAGAATCACTAGTGTC | 2 | 2 | NC | NC |
| 2563 | 4094 | GACCAGAGAATCACTAGTGT | 2 | NC | NC | NC |
| 2564 | 4095 | GGACCAGAGAATCACTAGTG | 2 | NC | NC | NC |
| 2565 | 4096 | AGGACCAGAGAATCACTAGT | 2 | NC | NC | NC |
| 2566 | 4097 | AAGGACCAGAGAATCACTAG | 2 | NC | NC | NC |
| 2567 | 4098 | CAAGGACCAGAGAATCACTA | 2 | NC | NC | NC |
| 2568 | 4099 | ACAAGGACCAGAGAATCACT | 2 | NC | NC | NC |
| 2569 | 4100 | CACAAGGACCAGAGAATCAC | 2 | NC | NC | NC |
| 2570 | 4101 | CCACAAGGACCAGAGAATCA | 2 | NC | NC | NC |
| 2571 | 4102 | CCCACAAGGACCAGAGAATC | 2 | NC | NC | NC |
| 2572 | 4118 | ACATAGTGGTACTTTTCCCA | 2 | NC | NC | NC |
| 2573 | 4119 | AACATAGTGGTACTTTTCCC | 2 | NC | NC | NC |
| 2574 | 4120 | AAACATAGTGGTACTTTTCC | 1 | NC | NC | NC |
| 2575 | 4121 | AAAACATAGTGGTACTTTTC | 2 | NC | NC | NC |
| 2576 | 4122 | CAAAACATAGTGGTACTTTT | 2 | NC | NC | NC |
| 2577 | 4123 | ACAAAACATAGTGGTACTTT | 2 | NC | NC | NC |
| 2578 | 4124 | CACAAAACATAGTGGTACTT | 2 | NC | NC | NC |
| 2579 | 4130 | TCTTTCCACAAAACATAGTG | 1 | NC | NC | NC |
| 2580 | 4131 | CTCTTTCCACAAAACATAGT | 1 | NC | NC | NC |
| 2581 | 4132 | TCTCTTTCCACAAAACATAG | 1 | NC | NC | NC |
| 2582 | 4133 | TTCTCTTTCCACAAAACATA | 1 | NC | NC | NC |
| 2583 | 4134 | CTTCTCTTTCCACAAAACAT | 1 | NC | NC | NC |
| 2584 | 4135 | GCTTCTCTTTCCACAAAACA | 2 | 2 | NC | NC |
| 2585 | 4136 | GGCTTCTCTTTCCACAAAAC | 2 | 2 | NC | NC |
| 2586 | 4137 | TGGCTTCTCTTTCCACAAAA | 1 | 1 | NC | NC |
| 2587 | 4138 | TTGGCTTCTCTTTCCACAAA | 1 | 1 | NC | NC |
| 2588 | 4139 | ATTGGCTTCTCTTTCCACAA | 1 | 1 | NC | NC |
| 2589 | 4140 | CATTGGCTTCTCTTTCCACA | 1 | 1 | NC | NC |
| 2590 | 4141 | TCATTGGCTTCTCTTTCCAC | 1 | 1 | NC | NC |
| 2591 | 4142 | TTCATTGGCTTCTCTTTCCA | 2 | 1 | NC | NC |
| 2592 | 4143 | GTTCATTGGCTTCTCTTTCC | 2 | 1 | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 2593 | 4144 | AGTTCATTGGCTTCTCTTTC | 2 | 2 | NC | NC |
| 2594 | 4145 | AAGTTCATTGGCTTCTCTTT | 2 | 2 | NC | NC |
| 2595 | 4146 | GAAGTTCATTGGCTTCTCTT | 2 | 2 | NC | NC |
| 2596 | 4151 | TCTCCGAAGTTCATTGGCTT | 2 | 2 | NC | NC |
| 2597 | 4152 | CTCTCCGAAGTTCATTGGCT | 1 | 2 | NC | NC |
| 2598 | 4153 | CCTCTCCGAAGTTCATTGGC | 3 | 2 | NC | NC |
| 2599 | 4154 | TCCTCTCCGAAGTTCATTGG | 3 | 2 | NC | NC |
| 2600 | 4155 | TTCCTCTCCGAAGTTCATTG | 2 | 2 | NC | NC |
| 2601 | 4156 | CTTCCTCTCCGAAGTTCATT | 2 | 2 | NC | NC |
| 2602 | 4163 | AGTAGATCTTCCTCTCCGAA | 2 | 3 | NC | NC |
| 2603 | 4164 | CAGTAGATCTTCCTCTCCGA | 2 | 2 | NC | NC |
| 2604 | 4165 | ACAGTAGATCTTCCTCTCCG | 3 | 2 | NC | NC |
| 2605 | 4166 | CACAGTAGATCTTCCTCTCC | 2 | 2 | NC | NC |
| 2606 | 4167 | TCACAGTAGATCTTCCTCTC | 2 | 2 | NC | NC |
| 2607 | 4168 | GTCACAGTAGATCTTCCTCT | 2 | 2 | NC | NC |
| 2608 | 4169 | GGTCACAGTAGATCTTCCTC | 2 | 2 | NC | NC |
| 2609 | 4170 | TGGTCACAGTAGATCTTCCT | 2 | 2 | NC | NC |
| 2610 | 4171 | TTGGTCACAGTAGATCTTCC | 2 | 2 | NC | NC |
| 2611 | 4172 | CTTGGTCACAGTAGATCTTC | 2 | 2 | NC | NC |
| 2612 | 4173 | TCTTGGTCACAGTAGATCTT | 2 | 2 | NC | NC |
| 2613 | 4174 | CTCTTGGTCACAGTAGATCT | 2 | 2 | NC | NC |
| 2614 | 4175 | ACTCTTGGTCACAGTAGATC | 2 | 2 | NC | NC |
| 2615 | 4176 | TACTCTTGGTCACAGTAGAT | 2 | 2 | NC | NC |
| 2616 | 4177 | ATACTCTTGGTCACAGTAGA | 2 | 2 | NC | NC |
| 2617 | 4178 | AATACTCTTGGTCACAGTAG | 2 | NC | NC | NC |
| 2618 | 4179 | CAATACTCTTGGTCACAGTA | 2 | NC | NC | NC |
| 2619 | 4180 | ACAATACTCTTGGTCACAGT | 2 | NC | NC | NC |
| 2620 | 4181 | CACAATACTCTTGGTCACAG | 3 | NC | NC | NC |
| 2621 | 4182 | CCACAATACTCTTGGTCACA | 2 | NC | NC | NC |
| 2622 | 4183 | TCCACAATACTCTTGGTCAC | 2 | NC | NC | NC |
| 2623 | 4184 | CTCCACAATACTCTTGGTCA | 2 | NC | NC | NC |
| 2624 | 4185 | CCTCCACAATACTCTTGGTC | 2 | NC | NC | NC |
| 2625 | 4186 | TCCTCCACAATACTCTTGGT | 2 | NC | NC | NC |
| 2626 | 4187 | TTCCTCCACAATACTCTTGG | 2 | NC | NC | NC |
| 2627 | 4188 | ATTCCTCCACAATACTCTTG | 2 | NC | NC | NC |
| 2628 | 4189 | AATTCCTCCACAATACTCTT | 1 | NC | NC | NC |
| 2629 | 4190 | AAATTCCTCCACAATACTCT | 2 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 2630 | 4191 | TAAATTCCTCCACAATACTC | 1 | NC | NC | NC |
| 2631 | 4192 | ATAAATTCCTCCACAATACT | 1 | NC | NC | NC |
| 2632 | 4193 | GATAAATTCCTCCACAATAC | 1 | NC | NC | NC |
| 2633 | 4204 | AGTTGTTCTCGGATAAATTC | 2 | NC | NC | NC |
| 2634 | 4205 | CAGTTGTTCTCGGATAAATT | 2 | NC | NC | NC |
| 2635 | 4206 | CCAGTTGTTCTCGGATAAAT | 2 | NC | NC | NC |
| 2636 | 4207 | TCCAGTTGTTCTCGGATAAA | 3 | NC | NC | NC |
| 2637 | 4208 | CTCCAGTTGTTCTCGGATAA | 3 | NC | NC | NC |
| 2638 | 4209 | GCTCCAGTTGTTCTCGGATA | 3 | NC | NC | NC |
| 2639 | 4210 | AGCTCCAGTTGTTCTCGGAT | 2 | NC | NC | NC |
| 2640 | 4211 | TAGCTCCAGTTGTTCTCGGA | 2 | NC | NC | NC |
| 2641 | 4212 | GTAGCTCCAGTTGTTCTCGG | 1 | NC | NC | NC |
| 2642 | 4213 | AGTAGCTCCAGTTGTTCTCG | 2 | NC | NC | NC |
| 2643 | 4214 | GAGTAGCTCCAGTTGTTCTC | 2 | NC | NC | NC |
| 2644 | 4244 | CAATGTCCCTTGGATGCCTC | 2 | 2 | NC | NC |
| 2645 | 4245 | GCAATGTCCCTTGGATGCCT | 2 | 2 | NC | NC |
| 2646 | 4247 | TGGCAATGTCCCTTGGATGC | 2 | 2 | NC | NC |
| 2647 | 4248 | GTGGCAATGTCCCTTGGATG | 2 | 1 | NC | NC |
| 2648 | 4249 | AGTGGCAATGTCCCTTGGAT | 3 | 2 | NC | NC |
| 2649 | 4250 | CAGTGGCAATGTCCCTTGGA | 2 | 1 | NC | NC |
| 2650 | 4251 | TCAGTGGCAATGTCCCTTGG | 2 | 2 | NC | NC |
| 2651 | 4252 | GTCAGTGGCAATGTCCCTTG | 2 | 2 | NC | NC |
| 2652 | 4253 | AGTCAGTGGCAATGTCCCTT | 1 | 2 | NC | NC |
| 2653 | 4254 | CAGTCAGTGGCAATGTCCCT | 2 | 2 | NC | NC |
| 2654 | 4255 | ACAGTCAGTGGCAATGTCCC | 2 | 2 | NC | NC |
| 2655 | 4256 | GACAGTCAGTGGCAATGTCC | 2 | 2 | NC | NC |
| 2656 | 4257 | GGACAGTCAGTGGCAATGTC | 2 | 2 | NC | NC |
| 2657 | 4258 | TGGACAGTCAGTGGCAATGT | 1 | 2 | NC | NC |
| 2658 | 4259 | CTGGACAGTCAGTGGCAATG | 2 | 2 | NC | NC |
| 2659 | 4260 | TCTGGACAGTCAGTGGCAAT | 1 | 2 | NC | NC |
| 2660 | 4261 | TTCTGGACAGTCAGTGGCAA | 1 | 1 | NC | NC |
| 2661 | 4262 | CTTCTGGACAGTCAGTGGCA | 2 | 2 | 2 | NC |
| 2662 | 4264 | ACCTTCTGGACAGTCAGTGG | 2 | 3 | 2 | NC |
| 2663 | 4265 | CACCTTCTGGACAGTCAGTG | 2 | 2 | 1 | NC |
| 2664 | 4266 | ACACCTTCTGGACAGTCAGT | 2 | 2 | 2 | NC |
| 2665 | 4269 | CCAACACCTTCTGGACAGTC | 2 | 2 | 2 | 2 |
| 2666 | 4270 | GCCAACACCTTCTGGACAGT | 2 | 3 | 2 | 2 |

TABLE 2-continued

| Exemplary Oligonucleotides | | | | | | |
|---|---|---|---|---|---|---|
| SEQ | | | Off-target Score | | | |
| ID NO | Position | Sequence | Human | Cyno | Mouse | Rat |
| 2667 | 4271 | TGCCAACACCTTCTGGACAG | 2 | 2 | NC | NC |
| 2668 | 4272 | ATGCCAACACCTTCTGGACA | 2 | 2 | NC | NC |
| 2669 | 4273 | GATGCCAACACCTTCTGGAC | 2 | 3 | NC | NC |
| 2670 | 4274 | GGATGCCAACACCTTCTGGA | 2 | 2 | NC | NC |
| 2671 | 4276 | TGGGATGCCAACACCTTCTG | 2 | 2 | NC | NC |
| 2672 | 4277 | TTGGGATGCCAACACCTTCT | 3 | 2 | NC | NC |
| 2673 | 4278 | CTTGGGATGCCAACACCTTC | 2 | 2 | NC | NC |
| 2674 | 4279 | GCTTGGGATGCCAACACCTT | 2 | 2 | NC | NC |
| 2675 | 4302 | TAAACTTAATGGCCCCATGG | 3 | 2 | NC | NC |
| 2676 | 4303 | TTAAACTTAATGGCCCCATG | 2 | 2 | NC | NC |
| 2677 | 4312 | AGGCCATCATTAAACTTAAT | 2 | 2 | NC | NC |
| 2678 | 4313 | CAGGCCATCATTAAACTTAA | 2 | 2 | NC | NC |
| 2679 | 4314 | TCAGGCCATCATTAAACTTA | 1 | 2 | NC | NC |
| 2680 | 4315 | CTCAGGCCATCATTAAACTT | 1 | 2 | NC | NC |
| 2681 | 4316 | GCTCAGGCCATCATTAAACT | 1 | 2 | NC | NC |
| 2682 | 4330 | CAACTTTCCTGTAAGCTCAG | 1 | 2 | NC | NC |
| 2683 | 4331 | GCAACTTTCCTGTAAGCTCA | 2 | 1 | NC | NC |
| 2684 | 4332 | GGCAACTTTCCTGTAAGCTC | 2 | 2 | NC | NC |
| 2685 | 4333 | CGGCAACTTTCCTGTAAGCT | 2 | 2 | NC | NC |
| 2686 | 4334 | GCGGCAACTTTCCTGTAAGC | 2 | 2 | NC | NC |
| 2687 | 4335 | GGCGGCAACTTTCCTGTAAG | 2 | 3 | NC | NC |
| 2688 | 4336 | AGGCGGCAACTTTCCTGTAA | 2 | 3 | NC | NC |
| 2689 | 4337 | AAGGCGGCAACTTTCCTGTA | 2 | 3 | NC | NC |
| 2690 | 4338 | TAAGGCGGCAACTTTCCTGT | 3 | 2 | NC | NC |
| 2691 | 4339 | ATAAGGCGGCAACTTTCCTG | 3 | 3 | NC | NC |
| 2692 | 4340 | AATAAGGCGGCAACTTTCCT | 2 | 2 | NC | NC |
| 2693 | 4341 | CAATAAGGCGGCAACTTTCC | 2 | 2 | NC | NC |
| 2694 | 4342 | TCAATAAGGCGGCAACTTTC | 2 | 2 | NC | NC |
| 2695 | 4343 | TTCAATAAGGCGGCAACTTT | 2 | 2 | NC | NC |
| 2696 | 4344 | CTTCAATAAGGCGGCAACTT | 3 | NC | NC | NC |
| 2697 | 4345 | GCTTCAATAAGGCGGCAACT | 2 | NC | NC | NC |
| 2698 | 4346 | AGCTTCAATAAGGCGGCAAC | 3 | NC | NC | NC |
| 2699 | 4347 | GAGCTTCAATAAGGCGGCAA | 3 | NC | NC | NC |
| 2700 | 4348 | AGAGCTTCAATAAGGCGGCA | 3 | NC | NC | NC |
| 2701 | 4349 | CAGAGCTTCAATAAGGCGGC | 3 | NC | NC | NC |
| 2702 | 4350 | ACAGAGCTTCAATAAGGCGG | 2 | NC | NC | NC |
| 2703 | 4351 | GACAGAGCTTCAATAAGGCG | 2 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 2704 | 4352 | GGACAGAGCTTCAATAAGGC | 2 | NC | NC | NC |
| 2705 | 4353 | AGGACAGAGCTTCAATAAGG | 2 | NC | NC | NC |
| 2706 | 4354 | GAGGACAGAGCTTCAATAAG | 2 | NC | NC | NC |
| 2707 | 4355 | TGAGGACAGAGCTTCAATAA | 2 | NC | NC | NC |
| 2708 | 4356 | ATGAGGACAGAGCTTCAATA | 2 | NC | NC | NC |
| 2709 | 4357 | CATGAGGACAGAGCTTCAAT | 1 | NC | NC | NC |
| 2710 | 4358 | GCATGAGGACAGAGCTTCAA | 2 | NC | NC | NC |
| 2711 | 4359 | GGCATGAGGACAGAGCTTCA | 2 | NC | NC | NC |
| 2712 | 4360 | TGGCATGAGGACAGAGCTTC | 2 | NC | NC | NC |
| 2713 | 4379 | AGCACACTGGAATGGCAGCT | 2 | 2 | NC | NC |
| 2714 | 4381 | TGAGCACACTGGAATGGCAG | 1 | 1 | NC | NC |
| 2715 | 4398 | GCATAGAAGGTCTCCCGTGA | 3 | 2 | NC | NC |
| 2716 | 4399 | AGCATAGAAGGTCTCCCGTG | 2 | 2 | NC | NC |
| 2717 | 4400 | CAGCATAGAAGGTCTCCCGT | 3 | 2 | NC | NC |
| 2718 | 4404 | ACGGCAGCATAGAAGGTCTC | 2 | NC | NC | NC |
| 2719 | 4405 | AACGGCAGCATAGAAGGTCT | 2 | NC | NC | NC |
| 2720 | 4406 | TAACGGCAGCATAGAAGGTC | 2 | NC | NC | NC |
| 2721 | 4407 | CTAACGGCAGCATAGAAGGT | 2 | NC | NC | NC |
| 2722 | 4420 | TGGTCTATGTCAGCTAACGG | 2 | NC | NC | NC |
| 2723 | 4421 | GTGGTCTATGTCAGCTAACG | 3 | NC | NC | NC |
| 2724 | 4422 | AGTGGTCTATGTCAGCTAAC | 2 | NC | NC | NC |
| 2725 | 4423 | AAGTGGTCTATGTCAGCTAA | 2 | 3 | NC | NC |
| 2726 | 4424 | CAAGTGGTCTATGTCAGCTA | 3 | 3 | NC | NC |
| 2727 | 4425 | CCAAGTGGTCTATGTCAGCT | 2 | 2 | NC | NC |
| 2728 | 4426 | TCCAAGTGGTCTATGTCAGC | 2 | 2 | NC | NC |
| 2729 | 4427 | TTCCAAGTGGTCTATGTCAG | 2 | NC | NC | NC |
| 2730 | 4428 | GTTCCAAGTGGTCTATGTCA | 2 | NC | NC | NC |
| 2731 | 4429 | TGTTCCAAGTGGTCTATGTC | 2 | NC | NC | NC |
| 2732 | 4430 | CTGTTCCAAGTGGTCTATGT | 1 | NC | NC | NC |
| 2733 | 4431 | CCTGTTCCAAGTGGTCTATG | 2 | NC | NC | NC |
| 2734 | 4432 | TCCTGTTCCAAGTGGTCTAT | 2 | NC | NC | NC |
| 2735 | 4433 | TTCCTGTTCCAAGTGGTCTA | 2 | NC | NC | NC |
| 2736 | 4434 | TTTCCTGTTCCAAGTGGTCT | 2 | NC | NC | NC |
| 2737 | 4435 | TTTTCCTGTTCCAAGTGGTC | 1 | NC | NC | NC |
| 2738 | 4436 | TTTTTCCTGTTCCAAGTGGT | 2 | NC | NC | NC |
| 2739 | 4437 | GTTTTTCCTGTTCCAAGTGG | 1 | NC | NC | NC |
| 2740 | 4438 | TGTTTTTCCTGTTCCAAGTG | 1 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 2741 | 4439 | CTGTTTTTCCTGTTCCAAGT | 2 | NC | NC | NC |
| 2742 | 4440 | TCTGTTTTTCCTGTTCCAAG | 2 | NC | NC | NC |
| 2743 | 4441 | ATCTGTTTTTCCTGTTCCAA | 1 | NC | NC | NC |
| 2744 | 4442 | AATCTGTTTTTCCTGTTCCA | 1 | NC | NC | NC |
| 2745 | 4443 | TAATCTGTTTTTCCTGTTCC | 2 | NC | NC | NC |
| 2746 | 4444 | TTAATCTGTTTTTCCTGTTC | 1 | NC | NC | NC |
| 2747 | 4445 | TTTAATCTGTTTTTCCTGTT | 1 | NC | NC | NC |
| 2748 | 4446 | GTTTAATCTGTTTTTCCTGT | 1 | NC | NC | NC |
| 2749 | 4447 | GGTTTAATCTGTTTTTCCTG | 0 | 0 | NC | NC |
| 2750 | 4448 | GGGTTTAATCTGTTTTTCCT | 1 | 1 | NC | NC |
| 2751 | 4449 | TGGGTTTAATCTGTTTTTCC | 1 | 1 | NC | NC |
| 2752 | 4450 | TTGGGTTTAATCTGTTTTTC | 1 | 0 | NC | NC |
| 2753 | 4451 | GTTGGGTTTAATCTGTTTTT | 1 | NC | NC | NC |
| 2754 | 4452 | GGTTGGGTTTAATCTGTTTT | 1 | NC | NC | NC |
| 2755 | 4453 | AGGTTGGGTTTAATCTGTTT | 2 | NC | NC | NC |
| 2756 | 4454 | GAGGTTGGGTTTAATCTGTT | 2 | NC | NC | NC |
| 2757 | 4455 | TGAGGTTGGGTTTAATCTGT | 2 | NC | NC | NC |
| 2758 | 4456 | GTGAGGTTGGGTTTAATCTG | 2 | NC | NC | NC |
| 2759 | 4457 | AGTGAGGTTGGGTTTAATCT | 2 | NC | NC | NC |
| 2760 | 4458 | TAGTGAGGTTGGGTTTAATC | 2 | NC | NC | NC |
| 2761 | 4459 | TTAGTGAGGTTGGGTTTAAT | 1 | NC | NC | NC |
| 2762 | 4460 | TTTAGTGAGGTTGGGTTTAA | 2 | NC | NC | NC |
| 2763 | 4461 | GTTTAGTGAGGTTGGGTTTA | 2 | NC | NC | NC |
| 2764 | 4462 | AGTTTAGTGAGGTTGGGTTT | 2 | NC | NC | NC |
| 2765 | 4463 | AAGTTTAGTGAGGTTGGGTT | 1 | NC | NC | NC |
| 2766 | 4464 | GAAGTTTAGTGAGGTTGGGT | 2 | NC | NC | NC |
| 2767 | 4465 | CGAAGTTTAGTGAGGTTGGG | 2 | NC | NC | NC |
| 2768 | 4466 | GCGAAGTTTAGTGAGGTTGG | 3 | NC | NC | NC |
| 2769 | 4467 | TGCGAAGTTTAGTGAGGTTG | 3 | NC | NC | NC |
| 2770 | 4468 | TTGCGAAGTTTAGTGAGGTT | 2 | NC | NC | NC |
| 2771 | 4469 | TTTGCGAAGTTTAGTGAGGT | 3 | NC | NC | NC |
| 2772 | 4470 | TTTTGCGAAGTTTAGTGAGG | 2 | NC | NC | NC |
| 2773 | 4471 | ATTTTGCGAAGTTTAGTGAG | 3 | NC | NC | NC |
| 2774 | 4472 | CATTTTGCGAAGTTTAGTGA | 2 | NC | NC | NC |
| 2775 | 4473 | CCATTTTGCGAAGTTTAGTG | 3 | NC | NC | NC |
| 2776 | 4474 | GCCATTTTGCGAAGTTTAGT | 2 | NC | NC | NC |
| 2777 | 4475 | GGCCATTTTGCGAAGTTTAG | 2 | 2 | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 2778 | 4476 | GGGCCATTTTGCGAAGTTTA | 3 | 3 | NC | NC |
| 2779 | 4477 | TGGGCCATTTTGCGAAGTTT | 2 | 3 | NC | NC |
| 2780 | 4478 | CTGGGCCATTTTGCGAAGTT | 2 | 3 | NC | NC |
| 2781 | 4479 | CCTGGGCCATTTTGCGAAGT | 2 | 3 | NC | NC |
| 2782 | 4498 | TTTCCAAAGAGACGCCAGGC | 2 | 2 | NC | NC |
| 2783 | 4499 | TTTTCCAAAGAGACGCCAGG | 2 | 2 | NC | NC |
| 2784 | 4500 | CTTTTCCAAAGAGACGCCAG | 2 | 2 | NC | NC |
| 2785 | 4501 | GCTTTTCCAAAGAGACGCCA | 2 | 2 | NC | NC |
| 2786 | 4502 | TGCTTTTCCAAAGAGACGCC | 1 | 1 | NC | NC |
| 2787 | 4503 | CTGCTTTTCCAAAGAGACGC | 1 | 1 | NC | NC |
| 2788 | 4504 | TCTGCTTTTCCAAAGAGACG | 1 | 1 | NC | NC |
| 2789 | 4505 | CTCTGCTTTTCCAAAGAGAC | 2 | 2 | NC | NC |
| 2790 | 4506 | ACTCTGCTTTTCCAAAGAGA | 1 | 1 | NC | NC |
| 2791 | 4508 | ACACTCTGCTTTTCCAAAGA | 2 | 2 | NC | NC |
| 2792 | 4509 | CACACTCTGCTTTTCCAAAG | 2 | 2 | NC | NC |
| 2793 | 4510 | TCACACTCTGCTTTTCCAAA | 1 | 2 | NC | NC |
| 2794 | 4511 | ATCACACTCTGCTTTTCCAA | 2 | 1 | NC | NC |
| 2795 | 4512 | TATCACACTCTGCTTTTCCA | 2 | 2 | NC | NC |
| 2796 | 4513 | GTATCACACTCTGCTTTTCC | 1 | 2 | NC | NC |
| 2797 | 4514 | TGTATCACACTCTGCTTTTC | 2 | 2 | NC | NC |
| 2798 | 4515 | TTGTATCACACTCTGCTTTT | 1 | 1 | NC | NC |
| 2799 | 4516 | CTTGTATCACACTCTGCTTT | 1 | NC | NC | NC |
| 2800 | 4517 | CCTTGTATCACACTCTGCTT | 1 | NC | NC | NC |
| 2801 | 4518 | GCCTTGTATCACACTCTGCT | 2 | NC | NC | NC |
| 2802 | 4519 | TGCCTTGTATCACACTCTGC | 2 | NC | NC | NC |
| 2803 | 4520 | CTGCCTTGTATCACACTCTG | 2 | NC | NC | NC |
| 2804 | 4521 | TCTGCCTTGTATCACACTCT | 1 | NC | NC | NC |
| 2805 | 4522 | CTCTGCCTTGTATCACACTC | 2 | NC | NC | NC |
| 2806 | 4523 | GCTCTGCCTTGTATCACACT | 2 | NC | NC | NC |
| 2807 | 4549 | TCACAGGGAGGCATGGATTG | 2 | 2 | NC | NC |
| 2808 | 4562 | TTCTCATGGTGGCTCACAGG | 2 | 2 | NC | NC |
| 2809 | 4563 | GTTCTCATGGTGGCTCACAG | 2 | 2 | NC | NC |
| 2810 | 4564 | TGTTCTCATGGTGGCTCACA | 2 | 2 | NC | NC |
| 2811 | 4565 | CTGTTCTCATGGTGGCTCAC | 2 | 2 | NC | NC |
| 2812 | 4566 | TCTGTTCTCATGGTGGCTCA | 1 | 2 | NC | NC |
| 2813 | 4567 | TTCTGTTCTCATGGTGGCTC | 2 | 2 | NC | NC |
| 2814 | 4568 | ATTCTGTTCTCATGGTGGCT | 2 | 2 | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 2815 | 4569 | GATTCTGTTCTCATGGTGGC | 2 | 2 | NC | NC |
| 2816 | 4570 | TGATTCTGTTCTCATGGTGG | 2 | 2 | NC | NC |
| 2817 | 4571 | GTGATTCTGTTCTCATGGTG | 2 | 2 | NC | NC |
| 2818 | 4572 | AGTGATTCTGTTCTCATGGT | 2 | 2 | NC | NC |
| 2819 | 4577 | AGACCAGTGATTCTGTTCTC | 2 | 2 | NC | NC |
| 2820 | 4583 | CCTTTTAGACCAGTGATTCT | 1 | NC | NC | NC |
| 2821 | 4584 | TCCTTTTAGACCAGTGATTC | 1 | NC | NC | NC |
| 2822 | 4585 | TTCCTTTTAGACCAGTGATT | 2 | NC | NC | NC |
| 2823 | 4586 | GTTCCTTTTAGACCAGTGAT | 2 | NC | NC | NC |
| 2824 | 4587 | TGTTCCTTTTAGACCAGTGA | 2 | NC | NC | NC |
| 2825 | 4588 | TTGTTCCTTTTAGACCAGTG | 2 | NC | NC | NC |
| 2826 | 4589 | TTTGTTCCTTTTAGACCAGT | 1 | NC | NC | NC |
| 2827 | 4590 | CTTTGTTCCTTTTAGACCAG | 2 | NC | NC | NC |
| 2828 | 4591 | CCTTTGTTCCTTTTAGACCA | 2 | NC | NC | NC |
| 2829 | 4592 | CCCTTTGTTCCTTTTAGACC | 2 | NC | NC | NC |
| 2830 | 4593 | TCCCTTTGTTCCTTTTAGAC | 2 | NC | NC | NC |
| 2831 | 4594 | ATCCCTTTGTTCCTTTTAGA | 2 | NC | NC | NC |
| 2832 | 4595 | CATCCCTTTGTTCCTTTTAG | 2 | NC | NC | NC |
| 2833 | 4596 | ACATCCCTTTGTTCCTTTTA | 2 | NC | NC | NC |
| 2834 | 4597 | AACATCCCTTTGTTCCTTTT | 2 | NC | NC | NC |
| 2835 | 4604 | TACAGTGAACATCCCTTTGT | 2 | NC | NC | NC |
| 2836 | 4605 | ATACAGTGAACATCCCTTTG | 2 | NC | NC | NC |
| 2837 | 4606 | CATACAGTGAACATCCCTTT | 2 | NC | NC | NC |
| 2838 | 4607 | GCATACAGTGAACATCCCTT | 2 | NC | NC | NC |
| 2839 | 4608 | GGCATACAGTGAACATCCCT | 2 | NC | NC | NC |
| 2840 | 4609 | AGGCATACAGTGAACATCCC | 2 | NC | NC | NC |
| 2841 | 4610 | GAGGCATACAGTGAACATCC | 2 | NC | NC | NC |
| 2842 | 4611 | AGAGGCATACAGTGAACATC | 1 | NC | NC | NC |
| 2843 | 4612 | CAGAGGCATACAGTGAACAT | 2 | NC | NC | NC |
| 2844 | 4613 | TCAGAGGCATACAGTGAACA | 2 | NC | NC | NC |
| 2845 | 4614 | CTCAGAGGCATACAGTGAAC | 1 | NC | NC | NC |
| 2846 | 4615 | GCTCAGAGGCATACAGTGAA | 1 | 2 | NC | NC |
| 2847 | 4616 | TGCTCAGAGGCATACAGTGA | 1 | 2 | NC | NC |
| 2848 | 4672 | AGGGACACTGGGCTGATTCA | 2 | 2 | NC | NC |
| 2849 | 4683 | CTAAGCTGCTCAGGGACACT | 2 | 2 | NC | NC |
| 2850 | 4684 | TCTAAGCTGCTCAGGGACAC | 2 | 2 | NC | NC |
| 2851 | 4685 | GTCTAAGCTGCTCAGGGACA | 2 | 1 | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 2852 | 4686 | TGTCTAAGCTGCTCAGGGAC | 2 | 2 | NC | NC |
| 2853 | 4687 | CTGTCTAAGCTGCTCAGGGA | 2 | NC | NC | NC |
| 2854 | 4704 | TGATACAGAGAGCCCTGCTG | 2 | NC | NC | NC |
| 2855 | 4705 | CTGATACAGAGAGCCCTGCT | 2 | NC | NC | NC |
| 2856 | 4706 | ACTGATACAGAGAGCCCTGC | 2 | NC | NC | NC |
| 2857 | 4708 | AGACTGATACAGAGAGCCCT | 2 | NC | NC | NC |
| 2858 | 4709 | AAGACTGATACAGAGAGCCC | 2 | NC | NC | NC |
| 2859 | 4710 | AAAGACTGATACAGAGAGCC | 2 | NC | NC | NC |
| 2860 | 4711 | GAAAGACTGATACAGAGAGC | 1 | NC | NC | NC |
| 2861 | 4712 | AGAAAGACTGATACAGAGAG | 1 | NC | NC | NC |
| 2862 | 4713 | AAGAAAGACTGATACAGAGA | 2 | NC | NC | NC |
| 2863 | 4714 | CAAGAAAGACTGATACAGAG | 2 | NC | NC | NC |
| 2864 | 4715 | TCAAGAAAGACTGATACAGA | 2 | NC | NC | NC |
| 2865 | 4717 | GCTCAAGAAAGACTGATACA | 2 | NC | NC | NC |
| 2866 | 4718 | TGCTCAAGAAAGACTGATAC | 2 | NC | NC | NC |
| 2867 | 4719 | CTGCTCAAGAAAGACTGATA | 2 | NC | NC | NC |
| 2868 | 4720 | TCTGCTCAAGAAAGACTGAT | 2 | NC | NC | NC |
| 2869 | 4721 | ATCTGCTCAAGAAAGACTGA | 2 | NC | NC | NC |
| 2870 | 4722 | CATCTGCTCAAGAAAGACTG | 2 | NC | NC | NC |
| 2871 | 4723 | TCATCTGCTCAAGAAAGACT | 2 | NC | NC | NC |
| 2872 | 4724 | ATCATCTGCTCAAGAAAGAC | 2 | NC | NC | NC |
| 2873 | 4725 | AATCATCTGCTCAAGAAAGA | 2 | NC | NC | NC |
| 2874 | 4726 | GAATCATCTGCTCAAGAAAG | 2 | NC | NC | NC |
| 2875 | 4727 | GGAATCATCTGCTCAAGAAA | 2 | 2 | NC | NC |
| 2876 | 4728 | GGGAATCATCTGCTCAAGAA | 2 | NC | NC | NC |
| 2877 | 4746 | ATCTGGCTACTCAACTAGGG | 2 | NC | NC | NC |
| 2878 | 4747 | CATCTGGCTACTCAACTAGG | 2 | NC | NC | NC |
| 2879 | 4748 | TCATCTGGCTACTCAACTAG | 2 | NC | NC | NC |
| 2880 | 4749 | TTCATCTGGCTACTCAACTA | 2 | NC | NC | NC |
| 2881 | 4750 | TTTCATCTGGCTACTCAACT | 2 | NC | NC | NC |
| 2882 | 4751 | ATTTCATCTGGCTACTCAAC | 2 | NC | NC | NC |
| 2883 | 4752 | AATTTCATCTGGCTACTCAA | 2 | NC | NC | NC |
| 2884 | 4753 | GAATTTCATCTGGCTACTCA | 2 | NC | NC | NC |
| 2885 | 4754 | TGAATTTCATCTGGCTACTC | 2 | NC | NC | NC |
| 2886 | 4755 | TTGAATTTCATCTGGCTACT | 2 | NC | NC | NC |
| 2887 | 4756 | CTTGAATTTCATCTGGCTAC | 2 | NC | NC | NC |
| 2888 | 4757 | GCTTGAATTTCATCTGGCTA | 2 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 2889 | 4758 | GGCTTGAATTTCATCTGGCT | 2 | NC | NC | NC |
| 2890 | 4759 | AGGCTTGAATTTCATCTGGC | 2 | NC | NC | NC |
| 2891 | 4760 | TAGGCTTGAATTTCATCTGG | 2 | NC | NC | NC |
| 2892 | 4761 | TTAGGCTTGAATTTCATCTG | 3 | NC | NC | NC |
| 2893 | 4762 | TTTAGGCTTGAATTTCATCT | 2 | NC | NC | NC |
| 2894 | 4763 | CTTTAGGCTTGAATTTCATC | 2 | NC | NC | NC |
| 2895 | 4764 | TCTTTAGGCTTGAATTTCAT | 2 | NC | NC | NC |
| 2896 | 4765 | GTCTTTAGGCTTGAATTTCA | 2 | NC | NC | NC |
| 2897 | 4766 | TGTCTTTAGGCTTGAATTTC | 2 | NC | NC | NC |
| 2898 | 4767 | TTGTCTTTAGGCTTGAATTT | 2 | NC | NC | NC |
| 2899 | 4768 | ATTGTCTTTAGGCTTGAATT | 2 | NC | NC | NC |
| 2900 | 4769 | AATTGTCTTTAGGCTTGAAT | 2 | NC | NC | NC |
| 2901 | 4770 | GAATTGTCTTTAGGCTTGAA | 2 | NC | NC | NC |
| 2902 | 4771 | TGAATTGTCTTTAGGCTTGA | 2 | NC | NC | NC |
| 2903 | 4772 | ATGAATTGTCTTTAGGCTTG | 2 | NC | NC | NC |
| 2904 | 4773 | AATGAATTGTCTTTAGGCTT | 2 | NC | NC | NC |
| 2905 | 4774 | GAATGAATTGTCTTTAGGCT | 2 | NC | NC | NC |
| 2906 | 4775 | TGAATGAATTGTCTTTAGGC | 1 | NC | NC | NC |
| 2907 | 4776 | ATGAATGAATTGTCTTTAGG | 2 | NC | NC | NC |
| 2908 | 4777 | AATGAATGAATTGTCTTTAG | 1 | NC | NC | NC |
| 2909 | 4779 | CAAATGAATGAATTGTCTTT | 1 | NC | NC | NC |
| 2910 | 4780 | GCAAATGAATGAATTGTCTT | 2 | NC | NC | NC |
| 2911 | 4781 | TGCAAATGAATGAATTGTCT | 2 | NC | NC | NC |
| 2912 | 4782 | ATGCAAATGAATGAATTGTC | 2 | NC | NC | NC |
| 2913 | 4783 | GATGCAAATGAATGAATTGT | 2 | NC | NC | NC |
| 2914 | 4784 | GGATGCAAATGAATGAATTG | 2 | NC | NC | NC |
| 2915 | 4785 | TGGATGCAAATGAATGAATT | 2 | NC | NC | NC |
| 2916 | 4786 | ATGGATGCAAATGAATGAAT | 2 | NC | NC | NC |
| 2917 | 4787 | CATGGATGCAAATGAATGAA | 2 | 2 | NC | NC |
| 2918 | 4788 | CCATGGATGCAAATGAATGA | 2 | 2 | NC | NC |
| 2919 | 4789 | CCCATGGATGCAAATGAATG | 2 | NC | NC | NC |
| 2920 | 4790 | GCCCATGGATGCAAATGAAT | 2 | NC | NC | NC |
| 2921 | 4791 | TGCCCATGGATGCAAATGAA | 2 | NC | NC | NC |
| 2922 | 4797 | CTTCTGTGCCCATGGATGCA | 2 | NC | NC | NC |
| 2923 | 4799 | ACCTTCTGTGCCCATGGATG | 2 | NC | NC | NC |
| 2924 | 4800 | AACCTTCTGTGCCCATGGAT | 1 | NC | NC | NC |
| 2925 | 4801 | CAACCTTCTGTGCCCATGGA | 2 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 2926 | 4803 | AGCAACCTTCTGTGCCCATG | 2 | NC | NC | NC |
| 2927 | 4804 | TAGCAACCTTCTGTGCCCAT | 2 | NC | NC | NC |
| 2928 | 4805 | ATAGCAACCTTCTGTGCCCA | 3 | NC | NC | NC |
| 2929 | 4806 | TATAGCAACCTTCTGTGCCC | 2 | NC | NC | NC |
| 2930 | 4807 | ATATAGCAACCTTCTGTGCC | 2 | NC | NC | NC |
| 2931 | 4808 | TATATAGCAACCTTCTGTGC | 1 | NC | NC | NC |
| 2932 | 4809 | CTATATAGCAACCTTCTGTG | 2 | NC | NC | NC |
| 2933 | 4810 | ACTATATAGCAACCTTCTGT | 2 | NC | NC | NC |
| 2934 | 4811 | TACTATATAGCAACCTTCTG | 2 | NC | NC | NC |
| 2935 | 4812 | ATACTATATAGCAACCTTCT | 2 | NC | NC | NC |
| 2936 | 4813 | GATACTATATAGCAACCTTC | 2 | NC | NC | NC |
| 2937 | 4814 | AGATACTATATAGCAACCTT | 2 | NC | NC | NC |
| 2938 | 4815 | TAGATACTATATAGCAACCT | 1 | NC | NC | NC |
| 2939 | 4816 | GTAGATACTATATAGCAACC | 2 | NC | NC | NC |
| 2940 | 4817 | GGTAGATACTATATAGCAAC | 3 | NC | NC | NC |
| 2941 | 4818 | AGGTAGATACTATATAGCAA | 2 | NC | NC | NC |
| 2942 | 4819 | AAGGTAGATACTATATAGCA | 2 | NC | NC | NC |
| 2943 | 4820 | AAAGGTAGATACTATATAGC | 2 | NC | NC | NC |
| 2944 | 4821 | AAAAGGTAGATACTATATAG | 2 | NC | NC | NC |
| 2945 | 4822 | CAAAAGGTAGATACTATATA | 1 | NC | NC | NC |
| 2946 | 4823 | GCAAAAGGTAGATACTATAT | 2 | 2 | NC | NC |
| 2947 | 4824 | AGCAAAAGGTAGATACTATA | 1 | 1 | NC | NC |
| 2948 | 4825 | TAGCAAAAGGTAGATACTAT | 1 | 1 | NC | NC |
| 2949 | 4826 | GTAGCAAAAGGTAGATACTA | 2 | 2 | NC | NC |
| 2950 | 4827 | AGTAGCAAAAGGTAGATACT | 2 | 2 | NC | NC |
| 2951 | 4828 | AAGTAGCAAAAGGTAGATAC | 2 | 2 | NC | NC |
| 2952 | 4829 | TAAGTAGCAAAAGGTAGATA | 1 | 1 | NC | NC |
| 2953 | 4830 | ATAAGTAGCAAAAGGTAGAT | 1 | 2 | NC | NC |
| 2954 | 4831 | AATAAGTAGCAAAAGGTAGA | 1 | 2 | NC | NC |
| 2955 | 4832 | AAATAAGTAGCAAAAGGTAG | 1 | 1 | NC | NC |
| 2956 | 4833 | TAAATAAGTAGCAAAAGGTA | 1 | 2 | NC | NC |
| 2957 | 4834 | TTAAATAAGTAGCAAAAGGT | 1 | 2 | NC | NC |
| 2958 | 4835 | ATTAAATAAGTAGCAAAAGG | 1 | 1 | NC | NC |
| 2959 | 4836 | CATTAAATAAGTAGCAAAAG | 0 | 2 | NC | NC |
| 2960 | 4861 | CAATCAAACTGTCATTAAAT | 2 | NC | NC | NC |
| 2961 | 4862 | CCAATCAAACTGTCATTAAA | 2 | NC | NC | NC |
| 2962 | 4863 | ACCAATCAAACTGTCATTAA | 2 | NC | NC | NC |

TABLE 2-continued

| Exemplary Oligonucleotides | | | | | | |
|---|---|---|---|---|---|---|
| SEQ | | | Off-target Score | | | |
| ID NO | Position | Sequence | Human | Cyno | Mouse | Rat |
| 2963 | 4864 | AACCAATCAAACTGTCATTA | 2 | NC | NC | NC |
| 2964 | 4865 | CAACCAATCAAACTGTCATT | 2 | NC | NC | NC |
| 2965 | 4866 | GCAACCAATCAAACTGTCAT | 1 | NC | NC | NC |
| 2966 | 4867 | AGCAACCAATCAAACTGTCA | 1 | NC | NC | NC |
| 2967 | 4868 | AAGCAACCAATCAAACTGTC | 2 | NC | NC | NC |
| 2968 | 4869 | CAAGCAACCAATCAAACTGT | 2 | NC | NC | NC |
| 2969 | 4870 | CCAAGCAACCAATCAAACTG | 2 | NC | NC | NC |
| 2970 | 4871 | ACCAAGCAACCAATCAAACT | 2 | NC | NC | NC |
| 2971 | 4872 | AACCAAGCAACCAATCAAAC | 1 | NC | NC | NC |
| 2972 | 4873 | AAACCAAGCAACCAATCAAA | 1 | NC | NC | NC |
| 2973 | 4874 | CAAACCAAGCAACCAATCAA | 1 | NC | NC | NC |
| 2974 | 4875 | ACAAACCAAGCAACCAATCA | 1 | NC | NC | NC |
| 2975 | 4876 | AACAAACCAAGCAACCAATC | 1 | NC | NC | NC |
| 2976 | 4877 | TAACAAACCAAGCAACCAAT | 2 | NC | NC | NC |
| 2977 | 4878 | ATAACAAACCAAGCAACCAA | 1 | NC | NC | NC |
| 2978 | 4879 | AATAACAAACCAAGCAACCA | 2 | NC | NC | NC |
| 2979 | 4880 | AAATAACAAACCAAGCAACC | 1 | NC | NC | NC |
| 2980 | 4881 | CAAATAACAAACCAAGCAAC | 1 | NC | NC | NC |
| 2981 | 4882 | TCAAATAACAAACCAAGCAA | 2 | NC | NC | NC |
| 2982 | 4883 | TTCAAATAACAAACCAAGCA | 2 | NC | NC | NC |
| 2983 | 4884 | CTTCAAATAACAAACCAAGC | 2 | NC | NC | NC |
| 2984 | 4885 | CCTTCAAATAACAAACCAAG | 2 | NC | NC | NC |
| 2985 | 4886 | CCCTTCAAATAACAAACCAA | 2 | NC | NC | NC |
| 2986 | 4887 | ACCCTTCAAATAACAAACCA | 2 | NC | NC | NC |
| 2987 | 4888 | CACCCTTCAAATAACAAACC | 2 | NC | NC | NC |
| 2988 | 4889 | ACACCCTTCAAATAACAAAC | 2 | NC | NC | NC |
| 2989 | 4890 | CACACCCTTCAAATAACAAA | 2 | NC | NC | NC |
| 2990 | 4891 | TCACACCCTTCAAATAACAA | 2 | NC | NC | NC |
| 2991 | 4892 | ATCACACCCTTCAAATAACA | 2 | NC | NC | NC |
| 2992 | 4893 | AATCACACCCTTCAAATAAC | 2 | NC | NC | NC |
| 2993 | 4894 | AAATCACACCCTTCAAATAA | 2 | NC | NC | NC |
| 2994 | 4895 | AAAATCACACCCTTCAAATA | 2 | NC | NC | NC |
| 2995 | 4896 | AAAAATCACACCCTTCAAAT | 1 | NC | NC | NC |
| 2996 | 4897 | CAAAAATCACACCCTTCAAA | 1 | NC | NC | NC |
| 2997 | 4898 | ACAAAAATCACACCCTTCAA | 1 | NC | NC | NC |
| 2998 | 4899 | AACAAAAATCACACCCTTCA | 2 | NC | NC | NC |
| 2999 | 4900 | AAACAAAAATCACACCCTTC | 1 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 3000 | 4901 | AAAACAAAAATCACACCCTT | 1 | NC | NC | NC |
| 3001 | 4902 | AAAAACAAAAATCACACCCT | 0 | NC | NC | NC |
| 3002 | 4903 | CAAAAACAAAAATCACACCC | 0 | NC | NC | NC |
| 3003 | 4904 | ACAAAAACAAAAATCACACC | 0 | NC | NC | NC |
| 3004 | 4905 | TACAAAAACAAAAATCACAC | 1 | NC | NC | NC |
| 3005 | 4906 | GTACAAAAACAAAAATCACA | 1 | NC | NC | NC |
| 3006 | 4907 | TGTACAAAAACAAAAATCAC | 1 | NC | NC | NC |
| 3007 | 4908 | CTGTACAAAAACAAAAATCA | 1 | NC | NC | NC |
| 3008 | 4909 | ACTGTACAAAAACAAAAATC | 1 | NC | NC | NC |
| 3009 | 4931 | CAAATGTGAAGCTTGAAAAA | 2 | NC | NC | NC |
| 3010 | 4932 | GCAAATGTGAAGCTTGAAAA | 2 | NC | NC | NC |
| 3011 | 4933 | CGCAAATGTGAAGCTTGAAA | 2 | NC | NC | NC |
| 3012 | 4934 | ACGCAAATGTGAAGCTTGAA | 2 | NC | NC | NC |
| 3013 | 4944 | AATTAGATACACGCAAATGT | 2 | NC | NC | NC |
| 3014 | 4945 | GAATTAGATACACGCAAATG | 3 | NC | NC | NC |
| 3015 | 4946 | TGAATTAGATACACGCAAAT | 3 | NC | NC | NC |
| 3016 | 4947 | CTGAATTAGATACACGCAAA | 3 | NC | NC | NC |
| 3017 | 4948 | GCTGAATTAGATACACGCAA | 2 | NC | NC | NC |
| 3018 | 4949 | AGCTGAATTAGATACACGCA | 2 | NC | NC | NC |
| 3019 | 4950 | CAGCTGAATTAGATACACGC | 2 | NC | NC | NC |
| 3020 | 4951 | TCAGCTGAATTAGATACACG | 2 | NC | NC | NC |
| 3021 | 4952 | ATCAGCTGAATTAGATACAC | 1 | NC | NC | NC |
| 3022 | 4953 | CATCAGCTGAATTAGATACA | 2 | NC | NC | NC |
| 3023 | 4969 | ACCCCTTGGACTTGAGCATC | 2 | NC | NC | NC |
| 3024 | 4970 | TACCCCTTGGACTTGAGCAT | 1 | NC | NC | NC |
| 3025 | 4971 | CTACCCCTTGGACTTGAGCA | 2 | NC | NC | NC |
| 3026 | 4972 | ACTACCCCTTGGACTTGAGC | 2 | NC | NC | NC |
| 3027 | 4973 | GACTACCCCTTGGACTTGAG | 2 | NC | NC | NC |
| 3028 | 4974 | AGACTACCCCTTGGACTTGA | 2 | NC | NC | NC |
| 3029 | 4975 | CAGACTACCCCTTGGACTTG | 2 | NC | NC | NC |
| 3030 | 4976 | GCAGACTACCCCTTGGACTT | 3 | NC | NC | NC |
| 3031 | 4979 | AAGGCAGACTACCCCTTGGA | 2 | NC | NC | NC |
| 3032 | 5031 | AGACTGAAGGGAAAAGAGGG | 2 | NC | NC | NC |
| 3033 | 5032 | AAGACTGAAGGGAAAAGAGG | 1 | NC | NC | NC |
| 3034 | 5033 | GAAGACTGAAGGGAAAAGAG | 1 | NC | NC | NC |
| 3035 | 5034 | AGAAGACTGAAGGGAAAAGA | 2 | NC | NC | NC |
| 3036 | 5035 | AAGAAGACTGAAGGGAAAAG | 2 | NC | NC | NC |

TABLE 2-continued

| Exemplary Oligonucleotides | | | | | | |
|---|---|---|---|---|---|---|
| SEQ | | | Off-target Score | | | |
| ID NO | Position | Sequence | Human | Cyno | Mouse | Rat |
| 3037 | 5036 | GAAGAAGACTGAAGGGAAAA | 1 | NC | NC | NC |
| 3038 | 5037 | TGAAGAAGACTGAAGGGAAA | 1 | NC | NC | NC |
| 3039 | 5038 | GTGAAGAAGACTGAAGGGAA | 1 | NC | NC | NC |
| 3040 | 5039 | AGTGAAGAAGACTGAAGGGA | 1 | NC | NC | NC |
| 3041 | 5040 | AAGTGAAGAAGACTGAAGGG | 1 | NC | NC | NC |
| 3042 | 5041 | GAAGTGAAGAAGACTGAAGG | 2 | NC | NC | NC |
| 3043 | 5042 | GGAAGTGAAGAAGACTGAAG | 2 | NC | NC | NC |
| 3044 | 5043 | GGGAAGTGAAGAAGACTGAA | 1 | NC | NC | NC |
| 3045 | 5044 | AGGGAAGTGAAGAAGACTGA | 2 | NC | NC | NC |
| 3046 | 5045 | TAGGGAAGTGAAGAAGACTG | 2 | NC | NC | NC |
| 3047 | 5046 | ATAGGGAAGTGAAGAAGACT | 2 | NC | NC | NC |
| 3048 | 5047 | CATAGGGAAGTGAAGAAGAC | 2 | NC | NC | NC |
| 3049 | 5048 | GCATAGGGAAGTGAAGAAGA | 2 | NC | NC | NC |
| 3050 | 5049 | AGCATAGGGAAGTGAAGAAG | 2 | NC | NC | NC |
| 3051 | 5050 | CAGCATAGGGAAGTGAAGAA | 1 | NC | NC | NC |
| 3052 | 5051 | GCAGCATAGGGAAGTGAAGA | 2 | NC | NC | NC |
| 3053 | 5052 | AGCAGCATAGGGAAGTGAAG | 2 | NC | NC | NC |
| 3054 | 5053 | CAGCAGCATAGGGAAGTGAA | 2 | NC | NC | NC |
| 3055 | 5067 | TGTAGCACATGAAGCAGCAG | 2 | NC | NC | NC |
| 3056 | 5068 | ATGTAGCACATGAAGCAGCA | 2 | NC | NC | NC |
| 3057 | 5069 | GATGTAGCACATGAAGCAGC | 2 | NC | NC | NC |
| 3058 | 5070 | AGATGTAGCACATGAAGCAG | 2 | NC | NC | NC |
| 3059 | 5071 | GAGATGTAGCACATGAAGCA | 2 | NC | NC | NC |
| 3060 | 5072 | TGAGATGTAGCACATGAAGC | 2 | NC | NC | NC |
| 3061 | 5073 | CTGAGATGTAGCACATGAAG | 2 | NC | NC | NC |
| 3062 | 5074 | TCTGAGATGTAGCACATGAA | 2 | NC | NC | NC |
| 3063 | 5075 | GTCTGAGATGTAGCACATGA | 2 | NC | NC | NC |
| 3064 | 5076 | AGTCTGAGATGTAGCACATG | 2 | NC | NC | NC |
| 3065 | 5078 | TAAGTCTGAGATGTAGCACA | 2 | NC | NC | NC |
| 3066 | 5079 | TTAAGTCTGAGATGTAGCAC | 2 | NC | NC | NC |
| 3067 | 5080 | TTTAAGTCTGAGATGTAGCA | 2 | NC | NC | NC |
| 3068 | 5081 | CTTTAAGTCTGAGATGTAGC | 2 | NC | NC | NC |
| 3069 | 5082 | TCTTTAAGTCTGAGATGTAG | 2 | NC | NC | NC |
| 3070 | 5083 | CTCTTTAAGTCTGAGATGTA | 2 | NC | NC | NC |
| 3071 | 5084 | ACTCTTTAAGTCTGAGATGT | 1 | NC | NC | NC |
| 3072 | 5085 | AACTCTTTAAGTCTGAGATG | 2 | NC | NC | NC |
| 3073 | 5086 | AAACTCTTTAAGTCTGAGAT | 2 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 3074 | 5087 | GAAACTCTTTAAGTCTGAGA | 2 | NC | NC | NC |
| 3075 | 5088 | AGAAACTCTTTAAGTCTGAG | 1 | NC | NC | NC |
| 3076 | 5089 | GAGAAACTCTTTAAGTCTGA | 2 | NC | NC | NC |
| 3077 | 5090 | AGAGAAACTCTTTAAGTCTG | 2 | NC | NC | NC |
| 3078 | 5100 | TCACTGTAGTAGAGAAACTC | 2 | NC | NC | NC |
| 3079 | 5101 | TTCACTGTAGTAGAGAAACT | 2 | NC | NC | NC |
| 3080 | 5102 | TTTCACTGTAGTAGAGAAAC | 1 | NC | NC | NC |
| 3081 | 5104 | GTTTTCACTGTAGTAGAGAA | 1 | NC | NC | NC |
| 3082 | 5105 | TGTTTTCACTGTAGTAGAGA | 1 | NC | NC | NC |
| 3083 | 5106 | ATGTTTTCACTGTAGTAGAG | 1 | NC | NC | NC |
| 3084 | 5107 | AATGTTTTCACTGTAGTAGA | 1 | NC | NC | NC |
| 3085 | 5108 | GAATGTTTTCACTGTAGTAG | 2 | NC | NC | NC |
| 3086 | 5109 | AGAATGTTTTCACTGTAGTA | 2 | NC | NC | NC |
| 3087 | 5110 | GAGAATGTTTTCACTGTAGT | 2 | NC | NC | NC |
| 3088 | 5111 | AGAGAATGTTTTCACTGTAG | 2 | NC | NC | NC |
| 3089 | 5112 | TAGAGAATGTTTTCACTGTA | 2 | NC | NC | NC |
| 3090 | 5113 | CTAGAGAATGTTTTCACTGT | 2 | NC | NC | NC |
| 3091 | 5114 | CCTAGAGAATGTTTTCACTG | 2 | NC | NC | NC |
| 3092 | 5115 | CCCTAGAGAATGTTTTCACT | 2 | NC | NC | NC |
| 3093 | 5116 | ACCCTAGAGAATGTTTTCAC | 2 | NC | NC | NC |
| 3094 | 5117 | GACCCTAGAGAATGTTTTCA | 2 | NC | NC | NC |
| 3095 | 5118 | AGACCCTAGAGAATGTTTTC | 2 | NC | NC | NC |
| 3096 | 5119 | AAGACCCTAGAGAATGTTTT | 2 | NC | NC | NC |
| 3097 | 5120 | AAAGACCCTAGAGAATGTTT | 2 | NC | NC | NC |
| 3098 | 5121 | GAAAGACCCTAGAGAATGTT | 1 | NC | NC | NC |
| 3099 | 5122 | TGAAAGACCCTAGAGAATGT | 2 | NC | NC | NC |
| 3100 | 5123 | ATGAAAGACCCTAGAGAATG | 1 | NC | NC | NC |
| 3101 | 5124 | GATGAAAGACCCTAGAGAAT | 2 | NC | NC | NC |
| 3102 | 5125 | TGATGAAAGACCCTAGAGAA | 2 | NC | NC | NC |
| 3103 | 5126 | CTGATGAAAGACCCTAGAGA | 1 | NC | NC | NC |
| 3104 | 5127 | CCTGATGAAAGACCCTAGAG | 1 | NC | NC | NC |
| 3105 | 5128 | GCCTGATGAAAGACCCTAGA | 2 | NC | NC | NC |
| 3106 | 5129 | GGCCTGATGAAAGACCCTAG | 2 | NC | NC | NC |
| 3107 | 5130 | AGGCCTGATGAAAGACCCTA | 2 | NC | NC | NC |
| 3108 | 5131 | AAGGCCTGATGAAAGACCCT | 2 | NC | NC | NC |
| 3109 | 5132 | AAAGGCCTGATGAAAGACCC | 2 | NC | NC | NC |
| 3110 | 5133 | TAAAGGCCTGATGAAAGACC | 2 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 3111 | 5134 | CTAAAGGCCTGATGAAAGAC | 2 | NC | NC | NC |
| 3112 | 5135 | ACTAAAGGCCTGATGAAAGA | 2 | NC | NC | NC |
| 3113 | 5136 | AACTAAAGGCCTGATGAAAG | 2 | NC | NC | NC |
| 3114 | 5137 | TAACTAAAGGCCTGATGAAA | 2 | NC | NC | NC |
| 3115 | 5138 | ATAACTAAAGGCCTGATGAA | 2 | NC | NC | NC |
| 3116 | 5139 | AATAACTAAAGGCCTGATGA | 2 | NC | NC | NC |
| 3117 | 5140 | AAATAACTAAAGGCCTGATG | 2 | NC | NC | NC |
| 3118 | 5141 | AAAATAACTAAAGGCCTGAT | 2 | NC | NC | NC |
| 3119 | 5142 | TAAAATAACTAAAGGCCTGA | 2 | NC | NC | NC |
| 3120 | 5143 | CTAAAATAACTAAAGGCCTG | 2 | NC | NC | NC |
| 3121 | 5144 | CCTAAAATAACTAAAGGCCT | 1 | NC | NC | NC |
| 3122 | 5145 | CCCTAAAATAACTAAAGGCC | 2 | NC | NC | NC |
| 3123 | 5146 | TCCCTAAAATAACTAAAGGC | 2 | NC | NC | NC |
| 3124 | 5147 | ATCCCTAAAATAACTAAAGG | 2 | NC | NC | NC |
| 3125 | 5148 | TATCCCTAAAATAACTAAAG | 1 | NC | NC | NC |
| 3126 | 5153 | GTTTTTATCCCTAAAATAAC | 2 | NC | NC | NC |
| 3127 | 5158 | CAATAGTTTTTATCCCTAAA | 2 | NC | NC | NC |
| 3128 | 5159 | TCAATAGTTTTTATCCCTAA | 1 | NC | NC | NC |
| 3129 | 5160 | ATCAATAGTTTTTATCCCTA | 2 | NC | NC | NC |
| 3130 | 5161 | TATCAATAGTTTTTATCCCT | 1 | NC | NC | NC |
| 3131 | 5162 | TTATCAATAGTTTTTATCCC | 1 | NC | NC | NC |
| 3132 | 5169 | GTCCTTTTTATCAATAGTTT | 2 | NC | NC | NC |
| 3133 | 5170 | TGTCCTTTTTATCAATAGTT | 2 | NC | NC | NC |
| 3134 | 5171 | TTGTCCTTTTTATCAATAGT | 2 | NC | NC | NC |
| 3135 | 5172 | CTTGTCCTTTTTATCAATAG | 2 | NC | NC | NC |
| 3136 | 5173 | CCTTGTCCTTTTTATCAATA | 2 | NC | NC | NC |
| 3137 | 5174 | TCCTTGTCCTTTTTATCAAT | 2 | NC | NC | NC |
| 3138 | 5175 | ATCCTTGTCCTTTTTATCAA | 2 | NC | NC | NC |
| 3139 | 5176 | TATCCTTGTCCTTTTTATCA | 2 | NC | NC | NC |
| 3140 | 5177 | CTATCCTTGTCCTTTTTATC | 2 | NC | NC | NC |
| 3141 | 5178 | TCTATCCTTGTCCTTTTTAT | 2 | NC | NC | NC |
| 3142 | 5179 | TTCTATCCTTGTCCTTTTTA | 2 | NC | NC | NC |
| 3143 | 5180 | GTTCTATCCTTGTCCTTTTT | 2 | NC | NC | NC |
| 3144 | 5181 | TGTTCTATCCTTGTCCTTTT | 2 | NC | NC | NC |
| 3145 | 5182 | CTGTTCTATCCTTGTCCTTT | 2 | NC | NC | NC |
| 3146 | 5183 | TCTGTTCTATCCTTGTCCTT | 2 | NC | NC | NC |
| 3147 | 5184 | CTCTGTTCTATCCTTGTCCT | 2 | NC | NC | NC |

TABLE 2-continued

| Exemplary Oligonucleotides | | | | | | |
|---|---|---|---|---|---|---|
| SEQ | | | Off-target Score | | | |
| ID NO | Position | Sequence | Human | Cyno | Mouse | Rat |
| 3148 | 5185 | TCTCTGTTCTATCCTTGTCC | 2 | NC | NC | NC |
| 3149 | 5186 | TTCTCTGTTCTATCCTTGTC | 1 | NC | NC | NC |
| 3150 | 5187 | TTTCTCTGTTCTATCCTTGT | 2 | NC | NC | NC |
| 3151 | 5188 | TTTTCTCTGTTCTATCCTTG | 1 | NC | NC | NC |
| 3152 | 5189 | ATTTTCTCTGTTCTATCCTT | 1 | NC | NC | NC |
| 3153 | 5190 | AATTTTCTCTGTTCTATCCT | 1 | NC | NC | NC |
| 3154 | 5191 | AAATTTTCTCTGTTCTATCC | 1 | NC | NC | NC |
| 3155 | 5192 | TAAATTTTCTCTGTTCTATC | 1 | NC | NC | NC |
| 3156 | 5195 | CTTTAAATTTTCTCTGTTCT | 1 | NC | NC | NC |
| 3157 | 5196 | ACTTTAAATTTTCTCTGTTC | 1 | NC | NC | NC |
| 3158 | 5197 | GACTTTAAATTTTCTCTGTT | 1 | NC | NC | NC |
| 3159 | 5198 | GGACTTTAAATTTTCTCTGT | 2 | NC | NC | NC |
| 3160 | 5199 | AGGACTTTAAATTTTCTCTG | 2 | NC | NC | NC |
| 3161 | 5200 | CAGGACTTTAAATTTTCTCT | 2 | NC | NC | NC |
| 3162 | 5201 | ACAGGACTTTAAATTTTCTC | 2 | NC | NC | NC |
| 3163 | 5202 | AACAGGACTTTAAATTTTCT | 1 | NC | NC | NC |
| 3164 | 5203 | GAACAGGACTTTAAATTTTC | 2 | NC | NC | NC |
| 3165 | 5204 | GGAACAGGACTTTAAATTTT | 2 | NC | NC | NC |
| 3166 | 5205 | CGGAACAGGACTTTAAATTT | 2 | NC | NC | NC |
| 3167 | 5206 | CCGGAACAGGACTTTAAATT | 1 | NC | NC | NC |
| 3168 | 5207 | CCCGGAACAGGACTTTAAAT | 1 | NC | NC | NC |
| 3169 | 5208 | ACCCGGAACAGGACTTTAAA | 1 | NC | NC | NC |
| 3170 | 5209 | AACCCGGAACAGGACTTTAA | 2 | NC | NC | NC |
| 3171 | 5210 | AAACCCGGAACAGGACTTTA | 2 | NC | NC | NC |
| 3172 | 5211 | AAAACCCGGAACAGGACTTT | 2 | NC | NC | NC |
| 3173 | 5212 | AAAAACCCGGAACAGGACTT | 2 | NC | NC | NC |
| 3174 | 5239 | CTCTGAGTTTTTAAAGAAAA | 1 | NC | NC | NC |
| 3175 | 5240 | TCTCTGAGTTTTTAAAGAAA | 1 | NC | NC | NC |
| 3176 | 5241 | GTCTCTGAGTTTTTAAAGAA | 2 | NC | NC | NC |
| 3177 | 5242 | AGTCTCTGAGTTTTTAAAGA | 1 | NC | NC | NC |
| 3178 | 5243 | CAGTCTCTGAGTTTTTAAAG | 2 | NC | NC | NC |
| 3179 | 5244 | TCAGTCTCTGAGTTTTTAAA | 2 | NC | NC | NC |
| 3180 | 5254 | ATATTGAACATCAGTCTCTG | 1 | NC | NC | NC |
| 3181 | 5255 | GATATTGAACATCAGTCTCT | 1 | NC | NC | NC |
| 3182 | 5256 | GGATATTGAACATCAGTCTC | 2 | NC | NC | NC |
| 3183 | 5257 | GGGATATTGAACATCAGTCT | 1 | NC | NC | NC |
| 3184 | 5258 | TGGGATATTGAACATCAGTC | 1 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 3185 | 5259 | TTGGGATATTGAACATCAGT | 2 | NC | NC | NC |
| 3186 | 5260 | TTTGGGATATTGAACATCAG | 2 | NC | NC | NC |
| 3187 | 5261 | GTTTGGGATATTGAACATCA | 2 | NC | NC | NC |
| 3188 | 5262 | GGTTTGGGATATTGAACATC | 2 | NC | NC | NC |
| 3189 | 5263 | TGGTTTGGGATATTGAACAT | 2 | NC | NC | NC |
| 3190 | 5264 | CTGGTTTGGGATATTGAACA | 2 | NC | NC | NC |
| 3191 | 5265 | ACTGGTTTGGGATATTGAAC | 2 | NC | NC | NC |
| 3192 | 5266 | TACTGGTTTGGGATATTGAA | 2 | NC | NC | NC |
| 3193 | 5267 | TTACTGGTTTGGGATATTGA | 2 | NC | NC | NC |
| 3194 | 5268 | TTTACTGGTTTGGGATATTG | 1 | NC | NC | NC |
| 3195 | 5269 | TTTTACTGGTTTGGGATATT | 2 | NC | NC | NC |
| 3196 | 5270 | ATTTTACTGGTTTGGGATAT | 1 | NC | NC | NC |
| 3197 | 5271 | CATTTTACTGGTTTGGGATA | 1 | NC | NC | NC |
| 3198 | 5272 | CCATTTTACTGGTTTGGGAT | 1 | NC | NC | NC |
| 3199 | 5281 | GTATTTTCACCATTTTACTG | 1 | NC | NC | NC |
| 3200 | 5282 | AGTATTTTCACCATTTTACT | 1 | NC | NC | NC |
| 3201 | 5283 | TAGTATTTTCACCATTTTAC | 1 | NC | NC | NC |
| 3202 | 5285 | CATAGTATTTTCACCATTTT | 1 | NC | NC | NC |
| 3203 | 5286 | TCATAGTATTTTCACCATTT | 1 | NC | NC | NC |
| 3204 | 5287 | CTCATAGTATTTTCACCATT | 2 | NC | NC | NC |
| 3205 | 5288 | GCTCATAGTATTTTCACCAT | 2 | NC | NC | NC |
| 3206 | 5289 | AGCTCATAGTATTTTCACCA | 2 | NC | NC | NC |
| 3207 | 5290 | AAGCTCATAGTATTTTCACC | 2 | NC | NC | NC |
| 3208 | 5291 | CAAGCTCATAGTATTTTCAC | 2 | NC | NC | NC |
| 3209 | 5292 | ACAAGCTCATAGTATTTTCA | 1 | NC | NC | NC |
| 3210 | 5293 | AACAAGCTCATAGTATTTTC | 2 | NC | NC | NC |
| 3211 | 5294 | AAACAAGCTCATAGTATTTT | 2 | NC | NC | NC |
| 3212 | 5295 | AAAACAAGCTCATAGTATTT | 2 | NC | NC | NC |
| 3213 | 5296 | AAAAACAAGCTCATAGTATT | 2 | NC | NC | NC |
| 3214 | 5346 | CTTTCACATAAAGAGATACT | 2 | NC | NC | NC |
| 3215 | 5347 | GCTTTCACATAAAGAGATAC | 2 | NC | NC | NC |
| 3216 | 5348 | TGCTTTCACATAAAGAGATA | 2 | NC | NC | NC |
| 3217 | 5349 | TTGCTTTCACATAAAGAGAT | 2 | NC | NC | NC |
| 3218 | 5350 | ATTGCTTTCACATAAAGAGA | 2 | NC | NC | NC |
| 3219 | 5351 | AATTGCTTTCACATAAAGAG | 2 | NC | NC | NC |
| 3220 | 5352 | CAATTGCTTTCACATAAAGA | 2 | NC | NC | NC |
| 3221 | 5353 | ACAATTGCTTTCACATAAAG | 2 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 3222 | 5354 | GACAATTGCTTTCACATAAA | 2 | NC | NC | NC |
| 3223 | 5355 | TGACAATTGCTTTCACATAA | 2 | NC | NC | NC |
| 3224 | 5356 | ATGACAATTGCTTTCACATA | 2 | NC | NC | NC |
| 3225 | 5357 | TATGACAATTGCTTTCACAT | 2 | NC | NC | NC |
| 3226 | 5358 | ATATGACAATTGCTTTCACA | 2 | NC | NC | NC |
| 3227 | 5359 | GATATGACAATTGCTTTCAC | 2 | NC | NC | NC |
| 3228 | 5360 | TGATATGACAATTGCTTTCA | 2 | NC | NC | NC |
| 3229 | 5361 | TTGATATGACAATTGCTTTC | 2 | NC | NC | NC |
| 3230 | 5362 | TTTGATATGACAATTGCTTT | 2 | NC | NC | NC |
| 3231 | 5363 | TTTTGATATGACAATTGCTT | 2 | NC | NC | NC |
| 3232 | 5364 | GTTTTGATATGACAATTGCT | 2 | NC | NC | NC |
| 3233 | 5365 | TGTTTTGATATGACAATTGC | 2 | NC | NC | NC |
| 3234 | 5366 | GTGTTTTGATATGACAATTG | 2 | NC | NC | NC |
| 3235 | 5367 | TGTGTTTTGATATGACAATT | 2 | NC | NC | NC |
| 3236 | 5368 | CTGTGTTTTGATATGACAAT | 2 | NC | NC | NC |
| 3237 | 5369 | GCTGTGTTTTGATATGACAA | 2 | NC | NC | NC |
| 3238 | 5370 | TGCTGTGTTTTGATATGACA | 2 | NC | NC | NC |
| 3239 | 5371 | ATGCTGTGTTTTGATATGAC | 2 | NC | NC | NC |
| 3240 | 5372 | TATGCTGTGTTTTGATATGA | 1 | NC | NC | NC |
| 3241 | 5373 | GTATGCTGTGTTTTGATATG | 2 | NC | NC | NC |
| 3242 | 5374 | TGTATGCTGTGTTTTGATAT | 1 | NC | NC | NC |
| 3243 | 5375 | ATGTATGCTGTGTTTTGATA | 1 | NC | NC | NC |
| 3244 | 5376 | TATGTATGCTGTGTTTTGAT | 1 | NC | NC | NC |
| 3245 | 5377 | GTATGTATGCTGTGTTTTGA | 2 | NC | NC | NC |
| 3246 | 5378 | CGTATGTATGCTGTGTTTTG | 2 | NC | NC | NC |
| 3247 | 5379 | ACGTATGTATGCTGTGTTTT | 2 | NC | NC | NC |
| 3248 | 5380 | AACGTATGTATGCTGTGTTT | 2 | NC | NC | NC |
| 3249 | 5381 | GAACGTATGTATGCTGTGTT | 2 | NC | NC | NC |
| 3250 | 5382 | TGAACGTATGTATGCTGTGT | 2 | NC | NC | NC |
| 3251 | 5383 | TTGAACGTATGTATGCTGTG | 3 | NC | NC | NC |
| 3252 | 5384 | GTTGAACGTATGTATGCTGT | 3 | NC | NC | NC |
| 3253 | 5385 | GGTTGAACGTATGTATGCTG | 3 | NC | NC | NC |
| 3254 | 5386 | AGGTTGAACGTATGTATGCT | 2 | NC | NC | NC |
| 3255 | 5387 | TAGGTTGAACGTATGTATGC | 1 | NC | NC | NC |
| 3256 | 5388 | TTAGGTTGAACGTATGTATG | 2 | NC | NC | NC |
| 3257 | 5389 | GTTAGGTTGAACGTATGTAT | 2 | NC | NC | NC |
| 3258 | 5390 | GGTTAGGTTGAACGTATGTA | 2 | NC | NC | NC |

TABLE 2-continued

| Exemplary Oligonucleotides | | | | | | |
|---|---|---|---|---|---|---|
| SEQ | | | Off-target Score | | | |
| ID NO | Position | Sequence | Human | Cyno | Mouse | Rat |
| 3259 | 5391 | TGGTTAGGTTGAACGTATGT | 2 | NC | NC | NC |
| 3260 | 5392 | TTGGTTAGGTTGAACGTATG | 2 | NC | NC | NC |
| 3261 | 5393 | TTTGGTTAGGTTGAACGTAT | 2 | NC | NC | NC |
| 3262 | 5394 | ATTTGGTTAGGTTGAACGTA | 2 | NC | NC | NC |
| 3263 | 5395 | TATTTGGTTAGGTTGAACGT | 2 | NC | NC | NC |
| 3264 | 5396 | ATATTTGGTTAGGTTGAACG | 3 | NC | NC | NC |
| 3265 | 5397 | GATATTTGGTTAGGTTGAAC | 2 | NC | NC | NC |
| 3266 | 5398 | AGATATTTGGTTAGGTTGAA | 1 | NC | NC | NC |
| 3267 | 5399 | AAGATATTTGGTTAGGTTGA | 1 | NC | NC | NC |
| 3268 | 5400 | AAAGATATTTGGTTAGGTTG | 2 | NC | NC | NC |
| 3269 | 5401 | TAAAGATATTTGGTTAGGTT | 2 | NC | NC | NC |
| 3270 | 5402 | GTAAAGATATTTGGTTAGGT | 2 | NC | NC | NC |
| 3271 | 5403 | TGTAAAGATATTTGGTTAGG | 2 | NC | NC | NC |
| 3272 | 5404 | GTGTAAAGATATTTGGTTAG | 2 | NC | NC | NC |
| 3273 | 5405 | AGTGTAAAGATATTTGGTTA | 2 | NC | NC | NC |
| 3274 | 5406 | AAGTGTAAAGATATTTGGTT | 2 | NC | NC | NC |
| 3275 | 5407 | AAAGTGTAAAGATATTTGGT | 2 | NC | NC | NC |
| 3276 | 5408 | AAAAGTGTAAAGATATTTGG | 2 | NC | NC | NC |
| 3277 | 5414 | GAAAGAAAAAGTGTAAAGAT | 0 | NC | NC | NC |
| 3278 | 5415 | TGAAAGAAAAAGTGTAAAGA | 1 | NC | NC | NC |
| 3279 | 5416 | CTGAAAGAAAAAGTGTAAAG | 1 | NC | NC | NC |
| 3280 | 5417 | CCTGAAAGAAAAAGTGTAAA | 1 | NC | NC | NC |
| 3281 | 5418 | TCCTGAAAGAAAAAGTGTAA | 2 | NC | NC | NC |
| 3282 | 5419 | CTCCTGAAAGAAAAAGTGTA | 2 | NC | NC | NC |
| 3283 | 5420 | TCTCCTGAAAGAAAAAGTGT | 2 | NC | NC | NC |
| 3284 | 5421 | GTCTCCTGAAAGAAAAAGTG | 1 | NC | NC | NC |
| 3285 | 5422 | TGTCTCCTGAAAGAAAAAGT | 2 | NC | NC | NC |
| 3286 | 5423 | TTGTCTCCTGAAAGAAAAAG | 2 | NC | NC | NC |
| 3287 | 5424 | CTTGTCTCCTGAAAGAAAAA | 1 | NC | NC | NC |
| 3288 | 5425 | CCTTGTCTCCTGAAAGAAAA | 1 | NC | NC | NC |
| 3289 | 5426 | CCCTTGTCTCCTGAAAGAAA | 1 | NC | NC | NC |
| 3290 | 5427 | ACCCTTGTCTCCTGAAAGAA | 2 | NC | NC | NC |
| 3291 | 5428 | AACCCTTGTCTCCTGAAAGA | 2 | NC | NC | NC |
| 3292 | 5429 | GAACCCTTGTCTCCTGAAAG | 2 | NC | NC | NC |
| 3293 | 5430 | AGAACCCTTGTCTCCTGAAA | 2 | NC | NC | NC |
| 3294 | 5431 | AAGAACCCTTGTCTCCTGAA | 2 | NC | NC | NC |
| 3295 | 5432 | AAAGAACCCTTGTCTCCTGA | 2 | NC | NC | NC |

TABLE 2-continued

| Exemplary Oligonucleotides | | | | | | |
|---|---|---|---|---|---|---|
| SEQ | | | Off-target Score | | | |
| ID NO | Position | Sequence | Human | Cyno | Mouse | Rat |
| 3296 | 5433 | CAAAGAACCCTTGTCTCCTG | 2 | NC | NC | NC |
| 3297 | 5434 | CCAAAGAACCCTTGTCTCCT | 2 | NC | NC | NC |
| 3298 | 5435 | CCCAAAGAACCCTTGTCTCC | 2 | NC | NC | NC |
| 3299 | 5436 | ACCCAAAGAACCCTTGTCTC | 2 | NC | NC | NC |
| 3300 | 5437 | GACCCAAAGAACCCTTGTCT | 2 | NC | NC | NC |
| 3301 | 5438 | GGACCCAAAGAACCCTTGTC | 2 | NC | NC | NC |
| 3302 | 5444 | TGAAAGGGACCCAAAGAACC | 2 | NC | NC | NC |
| 3303 | 5445 | TTGAAAGGGACCCAAAGAAC | 2 | NC | NC | NC |
| 3304 | 5446 | TTTGAAAGGGACCCAAAGAA | 2 | NC | NC | NC |
| 3305 | 5447 | GTTTGAAAGGGACCCAAAGA | 2 | NC | NC | NC |
| 3306 | 5448 | CGTTTGAAAGGGACCCAAAG | 2 | NC | NC | NC |
| 3307 | 5457 | CCAAGATACCGTTTGAAAGG | 3 | NC | NC | NC |
| 3308 | 5458 | ACCAAGATACCGTTTGAAAG | 3 | NC | NC | NC |
| 3309 | 5459 | CACCAAGATACCGTTTGAAA | 2 | NC | NC | NC |
| 3310 | 5460 | ACACCAAGATACCGTTTGAA | 2 | NC | NC | NC |
| 3311 | 5461 | AACACCAAGATACCGTTTGA | 2 | NC | NC | NC |
| 3312 | 5462 | TAACACCAAGATACCGTTTG | 3 | NC | NC | NC |
| 3313 | 5463 | ATAACACCAAGATACCGTTT | 2 | NC | NC | NC |
| 3314 | 5464 | AATAACACCAAGATACCGTT | 2 | NC | NC | NC |
| 3315 | 5465 | TAATAACACCAAGATACCGT | 2 | NC | NC | NC |
| 3316 | 5466 | GTAATAACACCAAGATACCG | 2 | NC | NC | NC |
| 3317 | 5467 | TGTAATAACACCAAGATACC | 2 | NC | NC | NC |
| 3318 | 5468 | ATGTAATAACACCAAGATAC | 2 | NC | NC | NC |
| 3319 | 5469 | AATGTAATAACACCAAGATA | 1 | NC | NC | NC |
| 3320 | 5470 | TAATGTAATAACACCAAGAT | 2 | NC | NC | NC |
| 3321 | 5471 | ATAATGTAATAACACCAAGA | 2 | NC | NC | NC |
| 3322 | 5472 | CATAATGTAATAACACCAAG | 2 | NC | NC | NC |
| 3323 | 5473 | GCATAATGTAATAACACCAA | 2 | NC | NC | NC |
| 3324 | 5474 | GGCATAATGTAATAACACCA | 2 | NC | NC | NC |
| 3325 | 5475 | AGGCATAATGTAATAACACC | 2 | NC | NC | NC |
| 3326 | 5476 | TAGGCATAATGTAATAACAC | 2 | NC | NC | NC |
| 3327 | 5478 | GATAGGCATAATGTAATAAC | 2 | NC | NC | NC |
| 3328 | 5479 | AGATAGGCATAATGTAATAA | 2 | NC | NC | NC |
| 3329 | 5480 | TAGATAGGCATAATGTAATA | 1 | NC | NC | NC |
| 3330 | 5481 | ATAGATAGGCATAATGTAAT | 1 | NC | NC | NC |
| 3331 | 5482 | AATAGATAGGCATAATGTAA | 2 | NC | NC | NC |
| 3332 | 5483 | CAATAGATAGGCATAATGTA | 2 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 3333 | 5484 | GCAATAGATAGGCATAATGT | 2 | NC | NC | NC |
| 3334 | 5485 | GGCAATAGATAGGCATAATG | 2 | NC | NC | NC |
| 3335 | 5486 | GGGCAATAGATAGGCATAAT | 2 | NC | NC | NC |
| 3336 | 5487 | AGGGCAATAGATAGGCATAA | 2 | NC | NC | NC |
| 3337 | 5488 | AAGGGCAATAGATAGGCATA | 2 | NC | NC | NC |
| 3338 | 5489 | TAAGGGCAATAGATAGGCAT | 2 | NC | NC | NC |
| 3339 | 5490 | ATAAGGGCAATAGATAGGCA | 2 | NC | NC | NC |
| 3340 | 5491 | TATAAGGGCAATAGATAGGC | 2 | NC | NC | NC |
| 3341 | 5492 | TTATAAGGGCAATAGATAGG | 2 | NC | NC | NC |
| 3342 | 5493 | ATTATAAGGGCAATAGATAG | 2 | NC | NC | NC |
| 3343 | 5494 | TATTATAAGGGCAATAGATA | 2 | NC | NC | NC |
| 3344 | 5495 | ATATTATAAGGGCAATAGAT | 2 | NC | NC | NC |
| 3345 | 5496 | GATATTATAAGGGCAATAGA | 2 | NC | NC | NC |
| 3346 | 5497 | TGATATTATAAGGGCAATAG | 2 | NC | NC | NC |
| 3347 | 5498 | GTGATATTATAAGGGCAATA | 2 | NC | NC | NC |
| 3348 | 5499 | AGTGATATTATAAGGGCAAT | 2 | NC | NC | NC |
| 3349 | 5500 | AAGTGATATTATAAGGGCAA | 2 | NC | NC | NC |
| 3350 | 5501 | CAAGTGATATTATAAGGGCA | 2 | NC | NC | NC |
| 3351 | 5502 | CCAAGTGATATTATAAGGGC | 2 | NC | NC | NC |
| 3352 | 5503 | CCCAAGTGATATTATAAGGG | 3 | NC | NC | NC |
| 3353 | 5504 | TCCCAAGTGATATTATAAGG | 1 | NC | NC | NC |
| 3354 | 5505 | GTCCCAAGTGATATTATAAG | 2 | NC | NC | NC |
| 3355 | 5506 | GGTCCCAAGTGATATTATAA | 2 | NC | NC | NC |
| 3356 | 5507 | TGGTCCCAAGTGATATTATA | 2 | NC | NC | NC |
| 3357 | 5508 | CTGGTCCCAAGTGATATTAT | 2 | NC | NC | NC |
| 3358 | 5509 | CCTGGTCCCAAGTGATATTA | 2 | NC | NC | NC |
| 3359 | 5510 | TCCTGGTCCCAAGTGATATT | 1 | NC | NC | NC |
| 3360 | 5511 | GTCCTGGTCCCAAGTGATAT | 2 | NC | NC | NC |
| 3361 | 5512 | AGTCCTGGTCCCAAGTGATA | 2 | NC | NC | NC |
| 3362 | 5513 | CAGTCCTGGTCCCAAGTGAT | 1 | NC | NC | NC |
| 3363 | 5514 | TCAGTCCTGGTCCCAAGTGA | 1 | NC | NC | NC |
| 3364 | 5515 | ATCAGTCCTGGTCCCAAGTG | 2 | NC | NC | NC |
| 3365 | 5516 | GATCAGTCCTGGTCCCAAGT | 1 | NC | NC | NC |
| 3366 | 5518 | ACGATCAGTCCTGGTCCCAA | 2 | NC | NC | NC |
| 3367 | 5519 | AACGATCAGTCCTGGTCCCA | 3 | NC | NC | NC |
| 3368 | 5521 | AGAACGATCAGTCCTGGTCC | 2 | NC | NC | NC |
| 3369 | 5522 | CAGAACGATCAGTCCTGGTC | 3 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 3370 | 5523 | GCAGAACGATCAGTCCTGGT | 3 | NC | NC | NC |
| 3371 | 5524 | TGCAGAACGATCAGTCCTGG | 3 | NC | NC | NC |
| 3372 | 5525 | TTGCAGAACGATCAGTCCTG | 3 | NC | NC | NC |
| 3373 | 5526 | TTTGCAGAACGATCAGTCCT | 3 | NC | NC | NC |
| 3374 | 5527 | ATTTGCAGAACGATCAGTCC | 2 | NC | NC | NC |
| 3375 | 5528 | CATTTGCAGAACGATCAGTC | 2 | NC | NC | NC |
| 3376 | 5541 | ATGGCATAACAAGCATTTGC | 2 | NC | NC | NC |
| 3377 | 5543 | GAATGGCATAACAAGCATTT | 2 | NC | NC | NC |
| 3378 | 5544 | AGAATGGCATAACAAGCATT | 2 | NC | NC | NC |
| 3379 | 5545 | GAGAATGGCATAACAAGCAT | 2 | NC | NC | NC |
| 3380 | 5546 | TGAGAATGGCATAACAAGCA | 1 | NC | NC | NC |
| 3381 | 5547 | TTGAGAATGGCATAACAAGC | 1 | NC | NC | NC |
| 3382 | 5548 | ATTGAGAATGGCATAACAAG | 1 | NC | NC | NC |
| 3383 | 5549 | GATTGAGAATGGCATAACAA | 2 | NC | NC | NC |
| 3384 | 5550 | AGATTGAGAATGGCATAACA | 2 | NC | NC | NC |
| 3385 | 5551 | TAGATTGAGAATGGCATAAC | 2 | NC | NC | NC |
| 3386 | 5552 | ATAGATTGAGAATGGCATAA | 2 | NC | NC | NC |
| 3387 | 5553 | AATAGATTGAGAATGGCATA | 2 | NC | NC | NC |
| 3388 | 5554 | AAATAGATTGAGAATGGCAT | 2 | NC | NC | NC |
| 3389 | 5555 | AAAATAGATTGAGAATGGCA | 2 | NC | NC | NC |
| 3390 | 5556 | AAAAATAGATTGAGAATGGC | 2 | NC | NC | NC |
| 3391 | 5557 | GAAAAATAGATTGAGAATGG | 2 | NC | NC | NC |
| 3392 | 5558 | GGAAAAATAGATTGAGAATG | 1 | NC | NC | NC |
| 3393 | 5559 | GGGAAAAATAGATTGAGAAT | 1 | NC | NC | NC |
| 3394 | 5560 | CGGGAAAAATAGATTGAGAA | 2 | NC | NC | NC |
| 3395 | 5561 | GCGGGAAAAATAGATTGAGA | 2 | NC | NC | NC |
| 3396 | 5562 | TGCGGGAAAAATAGATTGAG | 3 | NC | NC | NC |
| 3397 | 5563 | GTGCGGGAAAAATAGATTGA | 2 | NC | NC | NC |
| 3398 | 5564 | GGTGCGGGAAAAATAGATTG | 2 | NC | NC | NC |
| 3399 | 5565 | AGGTGCGGGAAAAATAGATT | 2 | NC | NC | NC |
| 3400 | 5566 | AAGGTGCGGGAAAAATAGAT | 2 | NC | NC | NC |
| 3401 | 5567 | AAAGGTGCGGGAAAAATAGA | 2 | NC | NC | NC |
| 3402 | 5568 | AAAAGGTGCGGGAAAAATAG | 2 | NC | NC | NC |
| 3403 | 5569 | GAAAAGGTGCGGGAAAAATA | 2 | NC | NC | NC |
| 3404 | 5570 | TGAAAAGGTGCGGGAAAAAT | 2 | NC | NC | NC |
| 3405 | 5571 | GTGAAAAGGTGCGGGAAAAA | 2 | NC | NC | NC |
| 3406 | 5572 | TGTGAAAAGGTGCGGGAAAA | 2 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 3407 | 5573 | ATGTGAAAAGGTGCGGGAAA | 2 | NC | NC | NC |
| 3408 | 5574 | CATGTGAAAAGGTGCGGGAA | 2 | NC | NC | NC |
| 3409 | 5575 | TCATGTGAAAAGGTGCGGGA | 3 | NC | NC | NC |
| 3410 | 5576 | ATCATGTGAAAAGGTGCGGG | 3 | NC | NC | NC |
| 3411 | 5577 | AATCATGTGAAAAGGTGCGG | 3 | NC | NC | NC |
| 3412 | 5578 | AAATCATGTGAAAAGGTGCG | 2 | NC | NC | NC |
| 3413 | 5579 | CAAATCATGTGAAAAGGTGC | 2 | NC | NC | NC |
| 3414 | 5590 | CCTATTAACCACAAATCATG | 2 | NC | NC | NC |
| 3415 | 5591 | TCCTATTAACCACAAATCAT | 2 | NC | NC | NC |
| 3416 | 5592 | GTCCTATTAACCACAAATCA | 2 | NC | NC | NC |
| 3417 | 5593 | AGTCCTATTAACCACAAATC | 3 | NC | NC | NC |
| 3418 | 5594 | GAGTCCTATTAACCACAAAT | 3 | NC | NC | NC |
| 3419 | 5595 | TGAGTCCTATTAACCACAAA | 2 | NC | NC | NC |
| 3420 | 5596 | TTGAGTCCTATTAACCACAA | 2 | NC | NC | NC |
| 3421 | 5597 | GTTGAGTCCTATTAACCACA | 2 | NC | NC | NC |
| 3422 | 5598 | TGTTGAGTCCTATTAACCAC | 2 | NC | NC | NC |
| 3423 | 5599 | CTGTTGAGTCCTATTAACCA | 2 | NC | NC | NC |
| 3424 | 5600 | TCTGTTGAGTCCTATTAACC | 2 | NC | NC | NC |
| 3425 | 5601 | GTCTGTTGAGTCCTATTAAC | 2 | NC | NC | NC |
| 3426 | 5602 | AGTCTGTTGAGTCCTATTAA | 2 | NC | NC | NC |
| 3427 | 5603 | TAGTCTGTTGAGTCCTATTA | 2 | NC | NC | NC |
| 3428 | 5604 | TTAGTCTGTTGAGTCCTATT | 2 | NC | NC | NC |
| 3429 | 5605 | TTTAGTCTGTTGAGTCCTAT | 3 | NC | NC | NC |
| 3430 | 5606 | TTTTAGTCTGTTGAGTCCTA | 2 | NC | NC | NC |
| 3431 | 5607 | ATTTTAGTCTGTTGAGTCCT | 2 | NC | NC | NC |
| 3432 | 5608 | AATTTTAGTCTGTTGAGTCC | 2 | NC | NC | NC |
| 3433 | 5609 | CAATTTTAGTCTGTTGAGTC | 2 | NC | NC | NC |
| 3434 | 5610 | GCAATTTTAGTCTGTTGAGT | 2 | NC | NC | NC |
| 3435 | 5611 | TGCAATTTTAGTCTGTTGAG | 2 | NC | NC | NC |
| 3436 | 5612 | ATGCAATTTTAGTCTGTTGA | 2 | NC | NC | NC |
| 3437 | 5613 | TATGCAATTTTAGTCTGTTG | 2 | NC | NC | NC |
| 3438 | 5614 | CTATGCAATTTTAGTCTGTT | 2 | NC | NC | NC |
| 3439 | 5615 | ACTATGCAATTTTAGTCTGT | 2 | NC | NC | NC |
| 3440 | 5616 | TACTATGCAATTTTAGTCTG | 2 | NC | NC | NC |
| 3441 | 5617 | CTACTATGCAATTTTAGTCT | 2 | NC | NC | NC |
| 3442 | 5618 | TCTACTATGCAATTTTAGTC | 2 | NC | NC | NC |
| 3443 | 5619 | TTCTACTATGCAATTTTAGT | 2 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 3444 | 5620 | TTTCTACTATGCAATTTTAG | 2 | NC | NC | NC |
| 3445 | 5655 | GCAATAAACATTACCAGCTG | 2 | NC | NC | NC |
| 3446 | 5656 | TGCAATAAACATTACCAGCT | 2 | NC | NC | NC |
| 3447 | 5657 | TTGCAATAAACATTACCAGC | 2 | NC | NC | NC |
| 3448 | 5658 | GTTGCAATAAACATTACCAG | 2 | NC | NC | NC |
| 3449 | 5659 | AGTTGCAATAAACATTACCA | 2 | NC | NC | NC |
| 3450 | 5660 | CAGTTGCAATAAACATTACC | 2 | NC | NC | NC |
| 3451 | 5661 | CCAGTTGCAATAAACATTAC | 2 | NC | NC | NC |
| 3452 | 5662 | CCCAGTTGCAATAAACATTA | 2 | NC | NC | NC |
| 3453 | 5663 | CCCCAGTTGCAATAAACATT | 2 | NC | NC | NC |
| 3454 | 5664 | ACCCCAGTTGCAATAAACAT | 2 | NC | NC | NC |
| 3455 | 5665 | CACCCCAGTTGCAATAAACA | 2 | NC | NC | NC |
| 3456 | 5666 | GCACCCCAGTTGCAATAAAC | 2 | NC | NC | NC |
| 3457 | 5667 | AGCACCCCAGTTGCAATAAA | 2 | NC | NC | NC |
| 3458 | 5668 | TAGCACCCCAGTTGCAATAA | 2 | NC | NC | NC |
| 3459 | 5669 | ATAGCACCCCAGTTGCAATA | 2 | NC | NC | NC |
| 3460 | 5670 | TATAGCACCCCAGTTGCAAT | 2 | NC | NC | NC |
| 3461 | 5671 | GTATAGCACCCCAGTTGCAA | 3 | NC | NC | NC |
| 3462 | 5672 | TGTATAGCACCCCAGTTGCA | 2 | NC | NC | NC |
| 3463 | 5673 | TTGTATAGCACCCCAGTTGC | 3 | NC | NC | NC |
| 3464 | 5674 | ATTGTATAGCACCCCAGTTG | 2 | NC | NC | NC |
| 3465 | 5675 | AATTGTATAGCACCCCAGTT | 2 | NC | NC | NC |
| 3466 | 5676 | TAATTGTATAGCACCCCAGT | 2 | NC | NC | NC |
| 3467 | 5677 | CTAATTGTATAGCACCCCAG | 2 | NC | NC | NC |
| 3468 | 5678 | ACTAATTGTATAGCACCCCA | 3 | NC | NC | NC |
| 3469 | 5679 | TACTAATTGTATAGCACCCC | 2 | NC | NC | NC |
| 3470 | 5680 | TTACTAATTGTATAGCACCC | 2 | NC | NC | NC |
| 3471 | 5681 | CTTACTAATTGTATAGCACC | 2 | NC | NC | NC |
| 3472 | 5682 | TCTTACTAATTGTATAGCAC | 2 | NC | NC | NC |
| 3473 | 5683 | ATCTTACTAATTGTATAGCA | 2 | NC | NC | NC |
| 3474 | 5684 | CATCTTACTAATTGTATAGC | 2 | NC | NC | NC |
| 3475 | 5685 | TCATCTTACTAATTGTATAG | 2 | NC | NC | NC |
| 3476 | 5687 | CATCATCTTACTAATTGTAT | 1 | NC | NC | NC |
| 3477 | 5688 | GCATCATCTTACTAATTGTA | 2 | NC | NC | NC |
| 3478 | 5689 | TGCATCATCTTACTAATTGT | 2 | NC | NC | NC |
| 3479 | 5690 | TTGCATCATCTTACTAATTG | 2 | NC | NC | NC |
| 3480 | 5691 | ATTGCATCATCTTACTAATT | 2 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 3481 | 5692 | CATTGCATCATCTTACTAAT | 2 | NC | NC | NC |
| 3482 | 5693 | TCATTGCATCATCTTACTAA | 2 | NC | NC | NC |
| 3483 | 5694 | CTCATTGCATCATCTTACTA | 2 | NC | NC | NC |
| 3484 | 5695 | TCTCATTGCATCATCTTACT | 1 | NC | NC | NC |
| 3485 | 5696 | TTCTCATTGCATCATCTTAC | 2 | NC | NC | NC |
| 3486 | 5697 | ATTCTCATTGCATCATCTTA | 2 | NC | NC | NC |
| 3487 | 5698 | AATTCTCATTGCATCATCTT | 1 | NC | NC | NC |
| 3488 | 5699 | AAATTCTCATTGCATCATCT | 2 | NC | NC | NC |
| 3489 | 5700 | GAAATTCTCATTGCATCATC | 2 | NC | NC | NC |
| 3490 | 5701 | AGAAATTCTCATTGCATCAT | 2 | NC | NC | NC |
| 3491 | 5702 | TAGAAATTCTCATTGCATCA | 1 | NC | NC | NC |
| 3492 | 5703 | GTAGAAATTCTCATTGCATC | 1 | NC | NC | NC |
| 3493 | 5704 | AGTAGAAATTCTCATTGCAT | 1 | NC | NC | NC |
| 3494 | 5705 | AAGTAGAAATTCTCATTGCA | 2 | NC | NC | NC |
| 3495 | 5706 | AAAGTAGAAATTCTCATTGC | 2 | NC | NC | NC |
| 3496 | 5707 | AAAAGTAGAAATTCTCATTG | 1 | NC | NC | NC |
| 3497 | 5708 | CAAAAGTAGAAATTCTCATT | 2 | NC | NC | NC |
| 3498 | 5709 | ACAAAAGTAGAAATTCTCAT | 2 | NC | NC | NC |
| 3499 | 5710 | TACAAAAGTAGAAATTCTCA | 2 | NC | NC | NC |
| 3500 | 5711 | ATACAAAAGTAGAAATTCTC | 2 | NC | NC | NC |
| 3501 | 5715 | GGAAATACAAAAGTAGAAAT | 1 | NC | NC | NC |
| 3502 | 5716 | AGGAAATACAAAAGTAGAAA | 1 | NC | NC | NC |
| 3503 | 5717 | CAGGAAATACAAAAGTAGAA | 1 | NC | NC | NC |
| 3504 | 5718 | TCAGGAAATACAAAAGTAGA | 1 | NC | NC | NC |
| 3505 | 5719 | GTCAGGAAATACAAAAGTAG | 1 | NC | NC | NC |
| 3506 | 5720 | GGTCAGGAAATACAAAAGTA | 2 | NC | NC | NC |
| 3507 | 5721 | TGGTCAGGAAATACAAAAGT | 2 | NC | NC | NC |
| 3508 | 5722 | CTGGTCAGGAAATACAAAAG | 2 | NC | NC | NC |
| 3509 | 5723 | GCTGGTCAGGAAATACAAAA | 1 | NC | NC | NC |
| 3510 | 5724 | GGCTGGTCAGGAAATACAAA | 1 | NC | NC | NC |
| 3511 | 5725 | AGGCTGGTCAGGAAATACAA | 2 | NC | NC | NC |
| 3512 | 5726 | CAGGCTGGTCAGGAAATACA | 2 | NC | NC | NC |
| 3513 | 5727 | GCAGGCTGGTCAGGAAATAC | 2 | NC | NC | NC |
| 3514 | 5728 | AGCAGGCTGGTCAGGAAATA | 2 | NC | NC | NC |
| 3515 | 5742 | TAAAAGCCACTTTGAGCAGG | 2 | NC | NC | NC |
| 3516 | 5743 | ATAAAAGCCACTTTGAGCAG | 2 | NC | NC | NC |
| 3517 | 5744 | TATAAAAGCCACTTTGAGCA | 2 | NC | NC | NC |

TABLE 2-continued

| Exemplary Oligonucleotides | | | | | | |
|---|---|---|---|---|---|---|
| SEQ | | | Off-target Score | | | |
| ID NO | Position | Sequence | Human | Cyno | Mouse | Rat |
| 3518 | 5745 | ATATAAAAGCCACTTTGAGC | 2 | NC | NC | NC |
| 3519 | 5746 | GATATAAAAGCCACTTTGAG | 2 | NC | NC | NC |
| 3520 | 5747 | TGATATAAAAGCCACTTTGA | 2 | NC | NC | NC |
| 3521 | 5748 | TTGATATAAAAGCCACTTTG | 2 | NC | NC | NC |
| 3522 | 5749 | ATTGATATAAAAGCCACTTT | 2 | NC | NC | NC |
| 3523 | 5750 | AATTGATATAAAAGCCACTT | 2 | NC | NC | NC |
| 3524 | 5751 | CAATTGATATAAAAGCCACT | 2 | NC | NC | NC |
| 3525 | 5752 | TCAATTGATATAAAAGCCAC | 2 | NC | NC | NC |
| 3526 | 5753 | TTCAATTGATATAAAAGCCA | 2 | NC | NC | NC |
| 3527 | 5754 | ATTCAATTGATATAAAAGCC | 2 | NC | NC | NC |
| 3528 | 5755 | CATTCAATTGATATAAAAGC | 2 | NC | NC | NC |
| 3529 | 5762 | GGAAAATCATTCAATTGATA | 1 | NC | NC | NC |
| 3530 | 5763 | AGGAAAATCATTCAATTGAT | 1 | NC | NC | NC |
| 3531 | 5764 | GAGGAAAATCATTCAATTGA | 1 | NC | NC | NC |
| 3532 | 5765 | TGAGGAAAATCATTCAATTG | 2 | NC | NC | NC |
| 3533 | 5766 | ATGAGGAAAATCATTCAATT | 1 | NC | NC | NC |
| 3534 | 5786 | TTGGTTTCCTGTATTAAAAA | 2 | NC | NC | NC |
| 3535 | 5787 | ATTGGTTTCCTGTATTAAAA | 1 | NC | NC | NC |
| 3536 | 5788 | AATTGGTTTCCTGTATTAAA | 2 | NC | NC | NC |
| 3537 | 5789 | GAATTGGTTTCCTGTATTAA | 2 | NC | NC | NC |
| 3538 | 5790 | CGAATTGGTTTCCTGTATTA | 3 | NC | NC | NC |
| 3539 | 5791 | ACGAATTGGTTTCCTGTATT | 2 | NC | NC | NC |
| 3540 | 5792 | CACGAATTGGTTTCCTGTAT | 1 | NC | NC | NC |
| 3541 | 5793 | GCACGAATTGGTTTCCTGTA | 2 | NC | NC | NC |
| 3542 | 5794 | AGCACGAATTGGTTTCCTGT | 3 | NC | NC | NC |
| 3543 | 5795 | GAGCACGAATTGGTTTCCTG | 2 | NC | NC | NC |
| 3544 | 5796 | TGAGCACGAATTGGTTTCCT | 2 | NC | NC | NC |
| 3545 | 5797 | ATGAGCACGAATTGGTTTCC | 2 | NC | NC | NC |
| 3546 | 5798 | CATGAGCACGAATTGGTTTC | 3 | NC | NC | NC |
| 3547 | 5799 | CCATGAGCACGAATTGGTTT | 2 | NC | NC | NC |
| 3548 | 5800 | TCCATGAGCACGAATTGGTT | 2 | NC | NC | NC |
| 3549 | 5802 | CTTCCATGAGCACGAATTGG | 3 | NC | NC | NC |
| 3550 | 5803 | TCTTCCATGAGCACGAATTG | 3 | NC | NC | NC |
| 3551 | 5804 | TTCTTCCATGAGCACGAATT | 2 | NC | NC | NC |
| 3552 | 5805 | TTTCTTCCATGAGCACGAAT | 2 | NC | NC | NC |
| 3553 | 5806 | TTTTCTTCCATGAGCACGAA | 2 | NC | NC | NC |
| 3554 | 5807 | CTTTTCTTCCATGAGCACGA | 2 | NC | NC | NC |

TABLE 2-continued

| Exemplary Oligonucleotides | | | | | | |
|---|---|---|---|---|---|---|
| SEQ | | | Off-target Score | | | |
| ID NO | Position | Sequence | Human | Cyno | Mouse | Rat |
| 3555 | 5808 | ACTTTTCTTCCATGAGCACG | 2 | NC | NC | NC |
| 3556 | 5809 | AACTTTTCTTCCATGAGCAC | 2 | NC | NC | NC |
| 3557 | 5810 | GAACTTTTCTTCCATGAGCA | 2 | NC | NC | NC |
| 3558 | 5835 | ATTCACTTCAAGGCTGCTGG | 2 | NC | NC | NC |
| 3559 | 5836 | GATTCACTTCAAGGCTGCTG | 2 | NC | NC | NC |
| 3560 | 5837 | AGATTCACTTCAAGGCTGCT | 2 | NC | NC | NC |
| 3561 | 5838 | AAGATTCACTTCAAGGCTGC | 2 | NC | NC | NC |
| 3562 | 5848 | TTGCTCCTGTAAGATTCACT | 2 | NC | NC | NC |
| 3563 | 5849 | ATTGCTCCTGTAAGATTCAC | 2 | NC | NC | NC |
| 3564 | 5850 | CATTGCTCCTGTAAGATTCA | 3 | NC | NC | NC |
| 3565 | 5851 | TCATTGCTCCTGTAAGATTC | 2 | NC | NC | NC |
| 3566 | 5852 | TTCATTGCTCCTGTAAGATT | 1 | NC | NC | NC |
| 3567 | 5853 | TTTCATTGCTCCTGTAAGAT | 1 | NC | NC | NC |
| 3568 | 5854 | CTTTCATTGCTCCTGTAAGA | 2 | NC | NC | NC |
| 3569 | 5855 | ACTTTCATTGCTCCTGTAAG | 2 | NC | NC | NC |
| 3570 | 5856 | TACTTTCATTGCTCCTGTAA | 2 | NC | NC | NC |
| 3571 | 5857 | ATACTTTCATTGCTCCTGTA | 2 | NC | NC | NC |
| 3572 | 5858 | AATACTTTCATTGCTCCTGT | 2 | NC | NC | NC |
| 3573 | 5859 | CAATACTTTCATTGCTCCTG | 2 | NC | NC | NC |
| 3574 | 5865 | TGAATGCAATACTTTCATTG | 2 | NC | NC | NC |
| 3575 | 5869 | CTAATGAATGCAATACTTTC | 0 | NC | NC | NC |
| 3576 | 5870 | GCTAATGAATGCAATACTTT | 1 | NC | NC | NC |
| 3577 | 5871 | CGCTAATGAATGCAATACTT | 1 | NC | NC | NC |
| 3578 | 5872 | ACGCTAATGAATGCAATACT | 1 | NC | NC | NC |
| 3579 | 5873 | GACGCTAATGAATGCAATAC | 2 | NC | NC | NC |
| 3580 | 5874 | AGACGCTAATGAATGCAATA | 2 | NC | NC | NC |
| 3581 | 5875 | CAGACGCTAATGAATGCAAT | 2 | NC | NC | NC |
| 3582 | 5876 | GCAGACGCTAATGAATGCAA | 2 | NC | NC | NC |
| 3583 | 5896 | TTCTCTGAACCTTCTCTGGG | 1 | NC | NC | NC |
| 3584 | 5897 | TTTCTCTGAACCTTCTCTGG | 1 | NC | NC | NC |
| 3585 | 5898 | TTTTCTCTGAACCTTCTCTG | 1 | NC | NC | NC |
| 3586 | 5899 | GTTTTCTCTGAACCTTCTCT | 1 | NC | NC | NC |
| 3587 | 5906 | AGTGAAGGTTTTCTCTGAAC | 2 | NC | NC | NC |
| 3588 | 5907 | AAGTGAAGGTTTTCTCTGAA | 1 | NC | NC | NC |
| 3589 | 5908 | CAAGTGAAGGTTTTCTCTGA | 1 | NC | NC | NC |
| 3590 | 5909 | ACAAGTGAAGGTTTTCTCTG | 1 | NC | NC | NC |
| 3591 | 5910 | AACAAGTGAAGGTTTTCTCT | 2 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 3592 | 5911 | AAACAAGTGAAGGTTTTCTC | 2 | NC | NC | NC |
| 3593 | 5916 | CTTGAAAACAAGTGAAGGTT | 2 | NC | NC | NC |
| 3594 | 5917 | CCTTGAAAACAAGTGAAGGT | 2 | NC | NC | NC |
| 3595 | 5918 | CCCTTGAAAACAAGTGAAGG | 2 | NC | NC | NC |
| 3596 | 5919 | CCCCTTGAAAACAAGTGAAG | 2 | NC | NC | NC |
| 3597 | 5920 | TCCCCTTGAAAACAAGTGAA | 2 | NC | NC | NC |
| 3598 | 5921 | ATCCCCTTGAAAACAAGTGA | 2 | NC | NC | NC |
| 3599 | 5922 | GATCCCCTTGAAAACAAGTG | 2 | NC | NC | NC |
| 3600 | 5923 | GGATCCCCTTGAAAACAAGT | 2 | NC | NC | NC |
| 3601 | 5935 | GTAAATCTACAAGGATCCCC | 3 | NC | NC | NC |
| 3602 | 5936 | CGTAAATCTACAAGGATCCC | 2 | NC | NC | NC |
| 3603 | 5937 | ACGTAAATCTACAAGGATCC | 2 | NC | NC | NC |
| 3604 | 5938 | TACGTAAATCTACAAGGATC | 2 | NC | NC | NC |
| 3605 | 5939 | TTACGTAAATCTACAAGGAT | 2 | NC | NC | NC |
| 3606 | 5940 | ATTACGTAAATCTACAAGGA | 2 | NC | NC | NC |
| 3607 | 5941 | AATTACGTAAATCTACAAGG | 2 | NC | NC | NC |
| 3608 | 5942 | CAATTACGTAAATCTACAAG | 2 | NC | NC | NC |
| 3609 | 5943 | CCAATTACGTAAATCTACAA | 2 | NC | NC | NC |
| 3610 | 5944 | TCCAATTACGTAAATCTACA | 2 | NC | NC | NC |
| 3611 | 5945 | TTCCAATTACGTAAATCTAC | 2 | NC | NC | NC |
| 3612 | 5946 | ATTCCAATTACGTAAATCTA | 2 | NC | NC | NC |
| 3613 | 5947 | GATTCCAATTACGTAAATCT | 2 | NC | NC | NC |
| 3614 | 5948 | GGATTCCAATTACGTAAATC | 1 | NC | NC | NC |
| 3615 | 5949 | AGGATTCCAATTACGTAAAT | 1 | NC | NC | NC |
| 3616 | 5950 | CAGGATTCCAATTACGTAAA | 2 | NC | NC | NC |
| 3617 | 5951 | TCAGGATTCCAATTACGTAA | 2 | NC | NC | NC |
| 3618 | 5952 | TTCAGGATTCCAATTACGTA | 2 | NC | NC | NC |
| 3619 | 5953 | CTTCAGGATTCCAATTACGT | 2 | NC | NC | NC |
| 3620 | 5954 | TCTTCAGGATTCCAATTACG | 1 | NC | NC | NC |
| 3621 | 5955 | TTCTTCAGGATTCCAATTAC | 0 | NC | NC | NC |
| 3622 | 5956 | GTTCTTCAGGATTCCAATTA | 0 | NC | NC | NC |
| 3623 | 5957 | TGTTCTTCAGGATTCCAATT | 1 | NC | NC | NC |
| 3624 | 5993 | TAGAAGAATAAAAGCCATTT | 2 | NC | NC | NC |
| 3625 | 5994 | TTAGAAGAATAAAAGCCATT | 1 | NC | NC | NC |
| 3626 | 5995 | TTTAGAAGAATAAAAGCCAT | 1 | NC | NC | NC |
| 3627 | 5996 | ATTTAGAAGAATAAAAGCCA | 1 | NC | NC | NC |
| 3628 | 5997 | TATTTAGAAGAATAAAAGCC | 1 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 3629 | 5998 | GTATTTAGAAGAATAAAAGC | 2 | NC | NC | NC |
| 3630 | 6007 | CGTTTATATGTATTTAGAAG | 2 | NC | NC | NC |
| 3631 | 6008 | CCGTTTATATGTATTTAGAA | 2 | NC | NC | NC |
| 3632 | 6009 | TCCGTTTATATGTATTTAGA | 2 | NC | NC | NC |
| 3633 | 6010 | ATCCGTTTATATGTATTTAG | 2 | NC | NC | NC |
| 3634 | 6011 | CATCCGTTTATATGTATTTA | 2 | NC | NC | NC |
| 3635 | 6012 | ACATCCGTTTATATGTATTT | 2 | NC | NC | NC |
| 3636 | 6013 | AACATCCGTTTATATGTATT | 2 | NC | NC | NC |
| 3637 | 6023 | CCATCTATAAAACATCCGTT | 2 | NC | NC | NC |
| 3638 | 6024 | CCCATCTATAAAACATCCGT | 2 | NC | NC | NC |
| 3639 | 6025 | TCCCATCTATAAAACATCCG | 3 | NC | NC | NC |
| 3640 | 6026 | TTCCCATCTATAAAACATCC | 2 | NC | NC | NC |
| 3641 | 6027 | CTTCCCATCTATAAAACATC | 2 | NC | NC | NC |
| 3642 | 6028 | TCTTCCCATCTATAAAACAT | 1 | NC | NC | NC |
| 3643 | 6029 | GTCTTCCCATCTATAAAACA | 1 | NC | NC | NC |
| 3644 | 6030 | TGTCTTCCCATCTATAAAAC | 1 | NC | NC | NC |
| 3645 | 6031 | ATGTCTTCCCATCTATAAAA | 1 | NC | NC | NC |
| 3646 | 6032 | CATGTCTTCCCATCTATAAA | 1 | NC | NC | NC |
| 3647 | 6033 | TCATGTCTTCCCATCTATAA | 2 | NC | NC | NC |
| 3648 | 6034 | GTCATGTCTTCCCATCTATA | 2 | NC | NC | NC |
| 3649 | 6035 | GGTCATGTCTTCCCATCTAT | 1 | NC | NC | NC |
| 3650 | 6036 | AGGTCATGTCTTCCCATCTA | 1 | NC | NC | NC |
| 3651 | 6037 | AAGGTCATGTCTTCCCATCT | 2 | NC | NC | NC |
| 3652 | 6038 | TAAGGTCATGTCTTCCCATC | 2 | NC | NC | NC |
| 3653 | 6039 | CTAAGGTCATGTCTTCCCAT | 2 | NC | NC | NC |
| 3654 | 6040 | TCTAAGGTCATGTCTTCCCA | 2 | NC | NC | NC |
| 3655 | 6041 | TTCTAAGGTCATGTCTTCCC | 2 | NC | NC | NC |
| 3656 | 6042 | TTTCTAAGGTCATGTCTTCC | 2 | NC | NC | NC |
| 3657 | 6043 | CTTTCTAAGGTCATGTCTTC | 2 | NC | NC | NC |
| 3658 | 6054 | AAAACTCTCTCCTTTCTAAG | 1 | NC | NC | NC |
| 3659 | 6055 | GAAAACTCTCTCCTTTCTAA | 1 | NC | NC | NC |
| 3660 | 6056 | TGAAAACTCTCTCCTTTCTA | 2 | NC | NC | NC |
| 3661 | 6057 | CTGAAAACTCTCTCCTTTCT | 1 | NC | NC | NC |
| 3662 | 6058 | TCTGAAAACTCTCTCCTTTC | 1 | NC | NC | NC |
| 3663 | 6059 | CTCTGAAAACTCTCTCCTTT | 1 | NC | NC | NC |
| 3664 | 6060 | CCTCTGAAAACTCTCTCCTT | 1 | NC | NC | NC |
| 3665 | 6061 | TCCTCTGAAAACTCTCTCCT | 1 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 3666 | 6062 | ATCCTCTGAAAACTCTCTCC | 1 | NC | NC | NC |
| 3667 | 6063 | AATCCTCTGAAAACTCTCTC | 1 | NC | NC | NC |
| 3668 | 6064 | AAATCCTCTGAAAACTCTCT | 1 | NC | NC | NC |
| 3669 | 6065 | CAAATCCTCTGAAAACTCTC | 2 | NC | NC | NC |
| 3670 | 6066 | GCAAATCCTCTGAAAACTCT | 2 | NC | NC | NC |
| 3671 | 6067 | GGCAAATCCTCTGAAAACTC | 2 | NC | NC | NC |
| 3672 | 6068 | TGGCAAATCCTCTGAAAACT | 1 | NC | NC | NC |
| 3673 | 6069 | CTGGCAAATCCTCTGAAAAC | 2 | NC | NC | NC |
| 3674 | 6070 | CCTGGCAAATCCTCTGAAAA | 1 | NC | NC | NC |
| 3675 | 6071 | GCCTGGCAAATCCTCTGAAA | 1 | NC | NC | NC |
| 3676 | 6072 | AGCCTGGCAAATCCTCTGAA | 1 | NC | NC | NC |
| 3677 | 6073 | CAGCCTGGCAAATCCTCTGA | 1 | NC | NC | NC |
| 3678 | 6074 | ACAGCCTGGCAAATCCTCTG | 2 | NC | NC | NC |
| 3679 | 6075 | GACAGCCTGGCAAATCCTCT | 1 | NC | NC | NC |
| 3680 | 6076 | TGACAGCCTGGCAAATCCTC | 2 | NC | NC | NC |
| 3681 | 6077 | CTGACAGCCTGGCAAATCCT | 2 | NC | NC | NC |
| 3682 | 6174 | TTACAACTCCCAGGACAGTT | 2 | NC | NC | NC |
| 3683 | 6175 | TTTACAACTCCCAGGACAGT | 1 | NC | NC | NC |
| 3684 | 6176 | TTTTACAACTCCCAGGACAG | 2 | NC | NC | NC |
| 3685 | 6177 | TTTTTACAACTCCCAGGACA | 2 | NC | NC | NC |
| 3686 | 6178 | ATTTTTACAACTCCCAGGAC | 2 | NC | NC | NC |
| 3687 | 6179 | GATTTTTACAACTCCCAGGA | 2 | NC | NC | NC |
| 3688 | 6180 | AGATTTTTACAACTCCCAGG | 2 | NC | NC | NC |
| 3689 | 6181 | AAGATTTTTACAACTCCCAG | 2 | NC | NC | NC |
| 3690 | 6182 | AAAGATTTTTACAACTCCCA | 2 | NC | NC | NC |
| 3691 | 6183 | AAAAGATTTTTACAACTCCC | 2 | NC | NC | NC |
| 3692 | 6184 | TAAAAGATTTTTACAACTCC | 2 | NC | NC | NC |
| 3693 | 6187 | CCTTAAAAGATTTTTACAAC | 2 | NC | NC | NC |
| 3694 | 6188 | GCCTTAAAAGATTTTTACAA | 1 | NC | NC | NC |
| 3695 | 6189 | GGCCTTAAAAGATTTTTACA | 2 | NC | NC | NC |
| 3696 | 6190 | TGGCCTTAAAAGATTTTTAC | 2 | NC | NC | NC |
| 3697 | 6191 | CTGGCCTTAAAAGATTTTTA | 1 | NC | NC | NC |
| 3698 | 6192 | TCTGGCCTTAAAAGATTTTT | 1 | NC | NC | NC |
| 3699 | 6193 | GTCTGGCCTTAAAAGATTTT | 2 | NC | NC | NC |
| 3700 | 6194 | GGTCTGGCCTTAAAAGATTT | 2 | NC | NC | NC |
| 3701 | 6206 | ATCCCTCAAATTGGTCTGGC | 2 | NC | NC | NC |
| 3702 | 6207 | AATCCCTCAAATTGGTCTGG | 2 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 3703 | 6208 | AAATCCCTCAAATTGGTCTG | 2 | NC | NC | NC |
| 3704 | 6209 | AAAATCCCTCAAATTGGTCT | 2 | NC | NC | NC |
| 3705 | 6210 | TAAAATCCCTCAAATTGGTC | 2 | NC | NC | NC |
| 3706 | 6211 | TTAAAATCCCTCAAATTGGT | 2 | NC | NC | NC |
| 3707 | 6212 | TTTAAAATCCCTCAAATTGG | 1 | NC | NC | NC |
| 3708 | 6213 | TTTTAAAATCCCTCAAATTG | 2 | NC | NC | NC |
| 3709 | 6215 | CTTTTTAAAATCCCTCAAAT | 1 | NC | NC | NC |
| 3710 | 6216 | ACTTTTTAAAATCCCTCAAA | 1 | NC | NC | NC |
| 3711 | 6217 | CACTTTTTAAAATCCCTCAA | 2 | NC | NC | NC |
| 3712 | 6218 | ACACTTTTTAAAATCCCTCA | 1 | NC | NC | NC |
| 3713 | 6219 | GACACTTTTTAAAATCCCTC | 1 | NC | NC | NC |
| 3714 | 6220 | AGACACTTTTTAAAATCCCT | 1 | NC | NC | NC |
| 3715 | 6221 | GAGACACTTTTTAAAATCCC | 2 | NC | NC | NC |
| 3716 | 6222 | TGAGACACTTTTTAAAATCC | 1 | NC | NC | NC |
| 3717 | 6223 | CTGAGACACTTTTTAAAATC | 1 | NC | NC | NC |
| 3718 | 6224 | ACTGAGACACTTTTTAAAAT | 1 | NC | NC | NC |
| 3719 | 6225 | CACTGAGACACTTTTTAAAA | 1 | NC | NC | NC |
| 3720 | 6226 | GCACTGAGACACTTTTTAAA | 2 | NC | NC | NC |
| 3721 | 6227 | GGCACTGAGACACTTTTTAA | 2 | NC | NC | NC |
| 3722 | 6228 | AGGCACTGAGACACTTTTTA | 2 | NC | NC | NC |
| 3723 | 6242 | TCTGAAATCATAAGAGGCAC | 1 | NC | NC | NC |
| 3724 | 6243 | TTCTGAAATCATAAGAGGCA | 2 | NC | NC | NC |
| 3725 | 6244 | CTTCTGAAATCATAAGAGGC | 2 | NC | NC | NC |
| 3726 | 6245 | CCTTCTGAAATCATAAGAGG | 2 | NC | NC | NC |
| 3727 | 6246 | ACCTTCTGAAATCATAAGAG | 2 | NC | NC | NC |
| 3728 | 6247 | AACCTTCTGAAATCATAAGA | 2 | NC | NC | NC |
| 3729 | 6248 | AAACCTTCTGAAATCATAAG | 2 | NC | NC | NC |
| 3730 | 6249 | AAAACCTTCTGAAATCATAA | 2 | NC | NC | NC |
| 3731 | 6250 | CAAAACCTTCTGAAATCATA | 2 | NC | NC | NC |
| 3732 | 6251 | GCAAAACCTTCTGAAATCAT | 2 | NC | NC | NC |
| 3733 | 6252 | AGCAAAACCTTCTGAAATCA | 1 | NC | NC | NC |
| 3734 | 6253 | TAGCAAAACCTTCTGAAATC | 2 | NC | NC | NC |
| 3735 | 6254 | ATAGCAAAACCTTCTGAAAT | 1 | NC | NC | NC |
| 3736 | 6255 | TATAGCAAAACCTTCTGAAA | 2 | NC | NC | NC |
| 3737 | 6256 | ATATAGCAAAACCTTCTGAA | 2 | NC | NC | NC |
| 3738 | 6257 | CATATAGCAAAACCTTCTGA | 2 | NC | NC | NC |
| 3739 | 6258 | ACATATAGCAAAACCTTCTG | 2 | NC | NC | NC |

TABLE 2-continued

| Exemplary Oligonucleotides | | | | | | |
|---|---|---|---|---|---|---|
| SEQ | | | Off-target Score | | | |
| ID NO | Position | Sequence | Human | Cyno | Mouse | Rat |
| 3740 | 6259 | TACATATAGCAAAACCTTCT | 2 | NC | NC | NC |
| 3741 | 6260 | TTACATATAGCAAAACCTTC | 2 | NC | NC | NC |
| 3742 | 6261 | ATTACATATAGCAAAACCTT | 2 | NC | NC | NC |
| 3743 | 6262 | GATTACATATAGCAAAACCT | 2 | NC | NC | NC |
| 3744 | 6263 | GGATTACATATAGCAAAACC | 2 | NC | NC | NC |
| 3745 | 6264 | GGGATTACATATAGCAAAAC | 2 | NC | NC | NC |
| 3746 | 6265 | TGGGATTACATATAGCAAAA | 2 | NC | NC | NC |
| 3747 | 6266 | TTGGGATTACATATAGCAAA | 2 | NC | NC | NC |
| 3748 | 6267 | GTTGGGATTACATATAGCAA | 2 | NC | NC | NC |
| 3749 | 6268 | AGTTGGGATTACATATAGCA | 2 | NC | NC | NC |
| 3750 | 6269 | TAGTTGGGATTACATATAGC | 2 | NC | NC | NC |
| 3751 | 6270 | GTAGTTGGGATTACATATAG | 2 | NC | NC | NC |
| 3752 | 6271 | AGTAGTTGGGATTACATATA | 1 | NC | NC | NC |
| 3753 | 6272 | CAGTAGTTGGGATTACATAT | 1 | NC | NC | NC |
| 3754 | 6273 | ACAGTAGTTGGGATTACATA | 1 | NC | NC | NC |
| 3755 | 6274 | AACAGTAGTTGGGATTACAT | 1 | NC | NC | NC |
| 3756 | 6275 | AAACAGTAGTTGGGATTACA | 2 | NC | NC | NC |
| 3757 | 6276 | AAAACAGTAGTTGGGATTAC | 2 | NC | NC | NC |
| 3758 | 6277 | GAAAACAGTAGTTGGGATTA | 2 | NC | NC | NC |
| 3759 | 6278 | AGAAAACAGTAGTTGGGATT | 1 | NC | NC | NC |
| 3760 | 6279 | AAGAAAACAGTAGTTGGGAT | 1 | NC | NC | NC |
| 3761 | 6280 | CAAGAAAACAGTAGTTGGGA | 2 | NC | NC | NC |
| 3762 | 6281 | TCAAGAAAACAGTAGTTGGG | 2 | NC | NC | NC |
| 3763 | 6282 | CTCAAGAAAACAGTAGTTGG | 2 | NC | NC | NC |
| 3764 | 6283 | TCTCAAGAAAACAGTAGTTG | 2 | NC | NC | NC |
| 3765 | 6285 | ACTCTCAAGAAAACAGTAGT | 2 | NC | NC | NC |
| 3766 | 6286 | TACTCTCAAGAAAACAGTAG | 2 | NC | NC | NC |
| 3767 | 6287 | CTACTCTCAAGAAAACAGTA | 2 | NC | NC | NC |
| 3768 | 6288 | GCTACTCTCAAGAAAACAGT | 2 | NC | NC | NC |
| 3769 | 6289 | TGCTACTCTCAAGAAAACAG | 2 | NC | NC | NC |
| 3770 | 6290 | CTGCTACTCTCAAGAAAACA | 2 | NC | NC | NC |
| 3771 | 6291 | TCTGCTACTCTCAAGAAAAC | 2 | NC | NC | NC |
| 3772 | 6292 | CTCTGCTACTCTCAAGAAAA | 2 | NC | NC | NC |
| 3773 | 6293 | CCTCTGCTACTCTCAAGAAA | 2 | NC | NC | NC |
| 3774 | 6294 | TCCTCTGCTACTCTCAAGAA | 2 | NC | NC | NC |
| 3775 | 6295 | ATCCTCTGCTACTCTCAAGA | 2 | NC | NC | NC |
| 3776 | 6296 | AATCCTCTGCTACTCTCAAG | 2 | NC | NC | NC |

TABLE 2-continued

| Exemplary Oligonucleotides | | | | | | |
|---|---|---|---|---|---|---|
| SEQ | | | Off-target Score | | | |
| ID NO | Position | Sequence | Human | Cyno | Mouse | Rat |
| 3777 | 6297 | TAATCCTCTGCTACTCTCAA | 2 | NC | NC | NC |
| 3778 | 6298 | CTAATCCTCTGCTACTCTCA | 2 | NC | NC | NC |
| 3779 | 6299 | TCTAATCCTCTGCTACTCTC | 2 | NC | NC | NC |
| 3780 | 6300 | TTCTAATCCTCTGCTACTCT | 1 | NC | NC | NC |
| 3781 | 6301 | TTTCTAATCCTCTGCTACTC | 1 | NC | NC | NC |
| 3782 | 6302 | TTTTCTAATCCTCTGCTACT | 2 | NC | NC | NC |
| 3783 | 6303 | TTTTTCTAATCCTCTGCTAC | 2 | NC | NC | NC |
| 3784 | 6304 | CTTTTTCTAATCCTCTGCTA | 1 | NC | NC | NC |
| 3785 | 6305 | ACTTTTTCTAATCCTCTGCT | 1 | NC | NC | NC |
| 3786 | 6306 | GACTTTTTCTAATCCTCTGC | 1 | NC | NC | NC |
| 3787 | 6307 | GGACTTTTTCTAATCCTCTG | 2 | NC | NC | NC |
| 3788 | 6308 | AGGACTTTTTCTAATCCTCT | 2 | NC | NC | NC |
| 3789 | 6311 | TGGAGGACTTTTTCTAATCC | 1 | NC | NC | NC |
| 3790 | 6312 | ATGGAGGACTTTTTCTAATC | 1 | NC | NC | NC |
| 3791 | 6313 | TATGGAGGACTTTTTCTAAT | 1 | NC | NC | NC |
| 3792 | 6314 | TTATGGAGGACTTTTTCTAA | 2 | NC | NC | NC |
| 3793 | 6315 | TTTATGGAGGACTTTTTCTA | 2 | NC | NC | NC |
| 3794 | 6316 | ATTTATGGAGGACTTTTTCT | 2 | NC | NC | NC |
| 3795 | 6317 | AATTTATGGAGGACTTTTTC | 2 | NC | NC | NC |
| 3796 | 6318 | TAATTTATGGAGGACTTTTT | 2 | NC | NC | NC |
| 3797 | 6319 | ATAATTTATGGAGGACTTTT | 2 | NC | NC | NC |
| 3798 | 6320 | CATAATTTATGGAGGACTTT | 2 | NC | NC | NC |
| 3799 | 6330 | AGGCCGGTTACATAATTTAT | 2 | NC | NC | NC |
| 3800 | 6331 | AAGGCCGGTTACATAATTTA | 2 | NC | NC | NC |
| 3801 | 6332 | GAAGGCCGGTTACATAATTT | 2 | NC | NC | NC |
| 3802 | 6333 | GGAAGGCCGGTTACATAATT | 2 | NC | NC | NC |
| 3803 | 6347 | AGTCAGGCTAGTCAGGAAGG | 2 | NC | NC | NC |
| 3804 | 6348 | GAGTCAGGCTAGTCAGGAAG | 2 | NC | NC | NC |
| 3805 | 6349 | TGAGTCAGGCTAGTCAGGAA | 2 | NC | NC | NC |
| 3806 | 6350 | TTGAGTCAGGCTAGTCAGGA | 2 | NC | NC | NC |
| 3807 | 6351 | CTTGAGTCAGGCTAGTCAGG | 2 | NC | NC | NC |
| 3808 | 6352 | GCTTGAGTCAGGCTAGTCAG | 2 | NC | NC | NC |
| 3809 | 6353 | TGCTTGAGTCAGGCTAGTCA | 2 | NC | NC | NC |
| 3810 | 6354 | TTGCTTGAGTCAGGCTAGTC | 3 | NC | NC | NC |
| 3811 | 6355 | ATTGCTTGAGTCAGGCTAGT | 2 | NC | NC | NC |
| 3812 | 6356 | CATTGCTTGAGTCAGGCTAG | 2 | NC | NC | NC |
| 3813 | 6357 | ACATTGCTTGAGTCAGGCTA | 2 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 3814 | 6358 | TACATTGCTTGAGTCAGGCT | 2 | NC | NC | NC |
| 3815 | 6359 | TTACATTGCTTGAGTCAGGC | 2 | NC | NC | NC |
| 3816 | 6360 | CTTACATTGCTTGAGTCAGG | 2 | NC | NC | NC |
| 3817 | 6361 | TCTTACATTGCTTGAGTCAG | 2 | NC | NC | NC |
| 3818 | 6362 | CTCTTACATTGCTTGAGTCA | 2 | NC | NC | NC |
| 3819 | 6363 | TCTCTTACATTGCTTGAGTC | 2 | NC | NC | NC |
| 3820 | 6364 | ATCTCTTACATTGCTTGAGT | 2 | NC | NC | NC |
| 3821 | 6365 | TATCTCTTACATTGCTTGAG | 2 | NC | NC | NC |
| 3822 | 6366 | TTATCTCTTACATTGCTTGA | 2 | NC | NC | NC |
| 3823 | 6367 | ATTATCTCTTACATTGCTTG | 2 | NC | NC | NC |
| 3824 | 6368 | AATTATCTCTTACATTGCTT | 2 | NC | NC | NC |
| 3825 | 6369 | TAATTATCTCTTACATTGCT | 2 | NC | NC | NC |
| 3826 | 6370 | ATAATTATCTCTTACATTGC | 2 | NC | NC | NC |
| 3827 | 6374 | CAGAATAATTATCTCTTACA | 1 | NC | NC | NC |
| 3828 | 6375 | ACAGAATAATTATCTCTTAC | 2 | NC | NC | NC |
| 3829 | 6379 | GAAAACAGAATAATTATCTC | 1 | NC | NC | NC |
| 3830 | 6396 | CCACACTTATAAATTATGAA | 2 | NC | NC | NC |
| 3831 | 6397 | CCCACACTTATAAATTATGA | 2 | NC | NC | NC |
| 3832 | 6398 | CCCCACACTTATAAATTATG | 2 | NC | NC | NC |
| 3833 | 6399 | CCCCCACACTTATAAATTAT | 2 | NC | NC | NC |
| 3834 | 6400 | GCCCCCACACTTATAAATTA | 2 | NC | NC | NC |
| 3835 | 6401 | TGCCCCCACACTTATAAATT | 2 | NC | NC | NC |
| 3836 | 6402 | ATGCCCCCACACTTATAAAT | 2 | NC | NC | NC |
| 3837 | 6403 | CATGCCCCCACACTTATAAA | 2 | NC | NC | NC |
| 3838 | 6404 | GCATGCCCCCACACTTATAA | 3 | NC | NC | NC |
| 3839 | 6405 | GGCATGCCCCCACACTTATA | 3 | NC | NC | NC |
| 3840 | 6423 | AGGTTGTTTTTATGCTGAGG | 2 | NC | NC | NC |
| 3841 | 6424 | TAGGTTGTTTTTATGCTGAG | 2 | NC | NC | NC |
| 3842 | 6425 | ATAGGTTGTTTTTATGCTGA | 1 | NC | NC | NC |
| 3843 | 6426 | AATAGGTTGTTTTTATGCTG | 1 | NC | NC | NC |
| 3844 | 6427 | TAATAGGTTGTTTTTATGCT | 2 | NC | NC | NC |
| 3845 | 6428 | CTAATAGGTTGTTTTTATGC | 2 | NC | NC | NC |
| 3846 | 6429 | CCTAATAGGTTGTTTTTATG | 2 | NC | NC | NC |
| 3847 | 6430 | CCCTAATAGGTTGTTTTTAT | 2 | NC | NC | NC |
| 3848 | 6431 | TCCCTAATAGGTTGTTTTTA | 2 | NC | NC | NC |
| 3849 | 6432 | TTCCCTAATAGGTTGTTTTT | 2 | NC | NC | NC |
| 3850 | 6433 | TTTCCCTAATAGGTTGTTTT | 1 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 3851 | 6434 | TTTTCCCTAATAGGTTGTTT | 1 | NC | NC | NC |
| 3852 | 6435 | TTTTTCCCTAATAGGTTGTT | 1 | NC | NC | NC |
| 3853 | 6436 | ATTTTTCCCTAATAGGTTGT | 1 | NC | NC | NC |
| 3854 | 6437 | TATTTTTCCCTAATAGGTTG | 2 | NC | NC | NC |
| 3855 | 6438 | ATATTTTTCCCTAATAGGTT | 2 | NC | NC | NC |
| 3856 | 6439 | GATATTTTTCCCTAATAGGT | 1 | NC | NC | NC |
| 3857 | 6440 | AGATATTTTTCCCTAATAGG | 1 | NC | NC | NC |
| 3858 | 6441 | TAGATATTTTTCCCTAATAG | 1 | NC | NC | NC |
| 3859 | 6445 | CTATTAGATATTTTTCCCTA | 1 | NC | NC | NC |
| 3860 | 6446 | TCTATTAGATATTTTTCCCT | 1 | NC | NC | NC |
| 3861 | 6447 | ATCTATTAGATATTTTTCCC | 1 | NC | NC | NC |
| 3862 | 6457 | GATAAAGGTAATCTATTAGA | 2 | NC | NC | NC |
| 3863 | 6458 | CGATAAAGGTAATCTATTAG | 3 | NC | NC | NC |
| 3864 | 6459 | GCGATAAAGGTAATCTATTA | 3 | NC | NC | NC |
| 3865 | 6460 | GGCGATAAAGGTAATCTATT | 3 | NC | NC | NC |
| 3866 | 6461 | AGGCGATAAAGGTAATCTAT | 2 | NC | NC | NC |
| 3867 | 6462 | CAGGCGATAAAGGTAATCTA | 2 | NC | NC | NC |
| 3868 | 6463 | ACAGGCGATAAAGGTAATCT | 3 | NC | NC | NC |
| 3869 | 6464 | AACAGGCGATAAAGGTAATC | 2 | NC | NC | NC |
| 3870 | 6465 | TAACAGGCGATAAAGGTAAT | 2 | NC | NC | NC |
| 3871 | 6466 | CTAACAGGCGATAAAGGTAA | 2 | NC | NC | NC |
| 3872 | 6467 | CCTAACAGGCGATAAAGGTA | 2 | NC | NC | NC |
| 3873 | 6468 | CCCTAACAGGCGATAAAGGT | 3 | NC | NC | NC |
| 3874 | 6469 | ACCCTAACAGGCGATAAAGG | 3 | NC | NC | NC |
| 3875 | 6470 | AACCCTAACAGGCGATAAAG | 3 | NC | NC | NC |
| 3876 | 6471 | AAACCCTAACAGGCGATAAA | 2 | NC | NC | NC |
| 3877 | 6472 | AAAACCCTAACAGGCGATAA | 2 | NC | NC | NC |
| 3878 | 6473 | TAAAACCCTAACAGGCGATA | 2 | NC | NC | NC |
| 3879 | 6474 | ATAAAACCCTAACAGGCGAT | 2 | NC | NC | NC |
| 3880 | 6475 | CATAAAACCCTAACAGGCGA | 3 | NC | NC | NC |
| 3881 | 6476 | ACATAAAACCCTAACAGGCG | 3 | NC | NC | NC |
| 3882 | 6477 | AACATAAAACCCTAACAGGC | 2 | NC | NC | NC |
| 3883 | 6478 | CAACATAAAACCCTAACAGG | 1 | NC | NC | NC |
| 3884 | 6479 | ACAACATAAAACCCTAACAG | 1 | NC | NC | NC |
| 3885 | 6480 | AACAACATAAAACCCTAACA | 1 | NC | NC | NC |
| 3886 | 6481 | AAACAACATAAAACCCTAAC | 2 | NC | NC | NC |
| 3887 | 6482 | AAAACAACATAAAACCCTAA | 1 | NC | NC | NC |

TABLE 2-continued

| Exemplary Oligonucleotides | | | | | | |
|---|---|---|---|---|---|---|
| SEQ | | | Off-target Score | | | |
| ID NO | Position | Sequence | Human | Cyno | Mouse | Rat |
| 3888 | 6483 | AAAAACAACATAAAACCCTA | 1 | NC | NC | NC |
| 3889 | 6484 | TAAAAACAACATAAAACCCT | 1 | NC | NC | NC |
| 3890 | 6485 | TTAAAAACAACATAAAACCC | 1 | NC | NC | NC |
| 3891 | 6486 | GTTAAAAACAACATAAAACC | 2 | NC | NC | NC |
| 3892 | 6490 | CTGAGTTAAAAACAACATAA | 1 | NC | NC | NC |
| 3893 | 6491 | TCTGAGTTAAAAACAACATA | 2 | NC | NC | NC |
| 3894 | 6492 | ATCTGAGTTAAAAACAACAT | 2 | NC | NC | NC |
| 3895 | 6493 | CATCTGAGTTAAAAACAACA | 1 | NC | NC | NC |
| 3896 | 6494 | GCATCTGAGTTAAAAACAAC | 2 | NC | NC | NC |
| 3897 | 6495 | GGCATCTGAGTTAAAAACAA | 2 | NC | NC | NC |
| 3898 | 6496 | TGGCATCTGAGTTAAAAACA | 2 | NC | NC | NC |
| 3899 | 6497 | ATGGCATCTGAGTTAAAAAC | 1 | NC | NC | NC |
| 3900 | 6498 | TATGGCATCTGAGTTAAAAA | 2 | NC | NC | NC |
| 3901 | 6499 | TTATGGCATCTGAGTTAAAA | 2 | NC | NC | NC |
| 3902 | 6500 | CTTATGGCATCTGAGTTAAA | 2 | NC | NC | NC |
| 3903 | 6501 | TCTTATGGCATCTGAGTTAA | 2 | NC | NC | NC |
| 3904 | 6502 | TTCTTATGGCATCTGAGTTA | 2 | NC | NC | NC |
| 3905 | 6503 | GTTCTTATGGCATCTGAGTT | 2 | NC | NC | NC |
| 3906 | 6504 | TGTTCTTATGGCATCTGAGT | 2 | NC | NC | NC |
| 3907 | 6505 | TTGTTCTTATGGCATCTGAG | 2 | NC | NC | NC |
| 3908 | 6506 | TTTGTTCTTATGGCATCTGA | 2 | NC | NC | NC |
| 3909 | 6507 | CTTTGTTCTTATGGCATCTG | 1 | NC | NC | NC |
| 3910 | 6508 | TCTTTGTTCTTATGGCATCT | 1 | NC | NC | NC |
| 3911 | 6509 | ATCTTTGTTCTTATGGCATC | 1 | NC | NC | NC |
| 3912 | 6510 | TATCTTTGTTCTTATGGCAT | 0 | NC | NC | NC |
| 3913 | 6511 | GTATCTTTGTTCTTATGGCA | 1 | NC | NC | NC |
| 3914 | 6512 | TGTATCTTTGTTCTTATGGC | 1 | NC | NC | NC |
| 3915 | 6513 | ATGTATCTTTGTTCTTATGG | 1 | NC | NC | NC |
| 3916 | 6514 | CATGTATCTTTGTTCTTATG | 2 | NC | NC | NC |
| 3917 | 6515 | ACATGTATCTTTGTTCTTAT | 2 | NC | NC | NC |
| 3918 | 6516 | TACATGTATCTTTGTTCTTA | 1 | NC | NC | NC |
| 3919 | 6517 | TTACATGTATCTTTGTTCTT | 2 | NC | NC | NC |
| 3920 | 6518 | ATTACATGTATCTTTGTTCT | 2 | NC | NC | NC |
| 3921 | 6519 | AATTACATGTATCTTTGTTC | 2 | NC | NC | NC |
| 3922 | 6550 | CACAATATAGGTATTAATGA | 2 | NC | NC | NC |
| 3923 | 6551 | GCACAATATAGGTATTAATG | 1 | NC | NC | NC |
| 3924 | 6552 | AGCACAATATAGGTATTAAT | 1 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 3925 | 6553 | AAGCACAATATAGGTATTAA | 2 | NC | NC | NC |
| 3926 | 6554 | AAAGCACAATATAGGTATTA | 2 | NC | NC | NC |
| 3927 | 6555 | TAAAGCACAATATAGGTATT | 1 | NC | NC | NC |
| 3928 | 6556 | TTAAAGCACAATATAGGTAT | 1 | NC | NC | NC |
| 3929 | 6557 | CTTAAAGCACAATATAGGTA | 2 | NC | NC | NC |
| 3930 | 6558 | CCTTAAAGCACAATATAGGT | 2 | NC | NC | NC |
| 3931 | 6559 | ACCTTAAAGCACAATATAGG | 2 | NC | NC | NC |
| 3932 | 6560 | AACCTTAAAGCACAATATAG | 2 | NC | NC | NC |
| 3933 | 6561 | AAACCTTAAAGCACAATATA | 2 | NC | NC | NC |
| 3934 | 6562 | TAAACCTTAAAGCACAATAT | 1 | NC | NC | NC |
| 3935 | 6563 | GTAAACCTTAAAGCACAATA | 1 | NC | NC | NC |
| 3936 | 6564 | TGTAAACCTTAAAGCACAAT | 1 | NC | NC | NC |
| 3937 | 6565 | TTGTAAACCTTAAAGCACAA | 1 | NC | NC | NC |
| 3938 | 6566 | TTTGTAAACCTTAAAGCACA | 1 | NC | NC | NC |
| 3939 | 6567 | TTTTGTAAACCTTAAAGCAC | 1 | NC | NC | NC |
| 3940 | 6568 | ATTTTGTAAACCTTAAAGCA | 1 | NC | NC | NC |
| 3941 | 6569 | TATTTTGTAAACCTTAAAGC | 1 | NC | NC | NC |
| 3942 | 6592 | CTAAGATAAAGTATGAGAAA | 2 | NC | NC | NC |
| 3943 | 6593 | ACTAAGATAAAGTATGAGAA | 1 | NC | NC | NC |
| 3944 | 6594 | AACTAAGATAAAGTATGAGA | 1 | NC | NC | NC |
| 3945 | 6595 | AAACTAAGATAAAGTATGAG | 2 | NC | NC | NC |
| 3946 | 6597 | CTAAACTAAGATAAAGTATG | 2 | NC | NC | NC |
| 3947 | 6601 | GAAACTAAACTAAGATAAAG | 1 | NC | NC | NC |
| 3948 | 6604 | CAAGAAACTAAACTAAGATA | 1 | NC | NC | NC |
| 3949 | 6605 | TCAAGAAACTAAACTAAGAT | 1 | NC | NC | NC |
| 3950 | 6606 | GTCAAGAAACTAAACTAAGA | 1 | NC | NC | NC |
| 3951 | 6607 | TGTCAAGAAACTAAACTAAG | 2 | NC | NC | NC |
| 3952 | 6608 | CTGTCAAGAAACTAAACTAA | 2 | NC | NC | NC |
| 3953 | 6609 | ACTGTCAAGAAACTAAACTA | 2 | NC | NC | NC |
| 3954 | 6610 | GACTGTCAAGAAACTAAACT | 2 | NC | NC | NC |
| 3955 | 6611 | GGACTGTCAAGAAACTAAAC | 2 | NC | NC | NC |
| 3956 | 6612 | TGGACTGTCAAGAAACTAAA | 1 | NC | NC | NC |
| 3957 | 6613 | ATGGACTGTCAAGAAACTAA | 1 | NC | NC | NC |
| 3958 | 6614 | CATGGACTGTCAAGAAACTA | 2 | NC | NC | NC |
| 3959 | 6615 | TCATGGACTGTCAAGAAACT | 2 | NC | NC | NC |
| 3960 | 6616 | CTCATGGACTGTCAAGAAAC | 2 | NC | NC | NC |
| 3961 | 6617 | CCTCATGGACTGTCAAGAAA | 2 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 3962 | 6625 | CCACCTTACCTCATGGACTG | 1 | NC | NC | NC |
| 3963 | 6626 | ACCACCTTACCTCATGGACT | 2 | NC | NC | NC |
| 3964 | 6627 | TACCACCTTACCTCATGGAC | 2 | NC | NC | NC |
| 3965 | 6628 | CTACCACCTTACCTCATGGA | 2 | NC | NC | NC |
| 3966 | 6630 | AGCTACCACCTTACCTCATG | 2 | NC | NC | NC |
| 3967 | 6631 | AAGCTACCACCTTACCTCAT | 2 | NC | NC | NC |
| 3968 | 6632 | AAAGCTACCACCTTACCTCA | 2 | NC | NC | NC |
| 3969 | 6633 | TAAAGCTACCACCTTACCTC | 2 | NC | NC | NC |
| 3970 | 6634 | ATAAAGCTACCACCTTACCT | 2 | NC | NC | NC |
| 3971 | 6635 | GATAAAGCTACCACCTTACC | 2 | NC | NC | NC |
| 3972 | 6636 | TGATAAAGCTACCACCTTAC | 2 | NC | NC | NC |
| 3973 | 6637 | GTGATAAAGCTACCACCTTA | 2 | NC | NC | NC |
| 3974 | 6643 | AAAATGGTGATAAAGCTACC | 1 | NC | NC | NC |
| 3975 | 6644 | TAAAATGGTGATAAAGCTAC | 1 | NC | NC | NC |
| 3976 | 6645 | GTAAAATGGTGATAAAGCTA | 1 | NC | NC | NC |
| 3977 | 6646 | TGTAAAATGGTGATAAAGCT | 2 | NC | NC | NC |
| 3978 | 6647 | TTGTAAAATGGTGATAAAGC | 2 | NC | NC | NC |
| 3979 | 6648 | TTTGTAAAATGGTGATAAAG | 1 | NC | NC | NC |
| 3980 | 6649 | CTTTGTAAAATGGTGATAAA | 1 | NC | NC | NC |
| 3981 | 6650 | ACTTTGTAAAATGGTGATAA | 1 | NC | NC | NC |
| 3982 | 6651 | CACTTTGTAAAATGGTGATA | 1 | NC | NC | NC |
| 3983 | 6652 | CCACTTTGTAAAATGGTGAT | 1 | NC | NC | NC |
| 3984 | 6653 | CCCACTTTGTAAAATGGTGA | 1 | NC | NC | NC |
| 3985 | 6654 | TCCCACTTTGTAAAATGGTG | 1 | NC | NC | NC |
| 3986 | 6655 | TTCCCACTTTGTAAAATGGT | 1 | NC | NC | NC |
| 3987 | 6656 | TTTCCCACTTTGTAAAATGG | 1 | NC | NC | NC |
| 3988 | 6657 | GTTTCCCACTTTGTAAAATG | 1 | NC | NC | NC |
| 3989 | 6658 | CGTTTCCCACTTTGTAAAAT | 2 | NC | NC | NC |
| 3990 | 6659 | TCGTTTCCCACTTTGTAAAA | 2 | NC | NC | NC |
| 3991 | 6660 | TTCGTTTCCCACTTTGTAAA | 1 | NC | NC | NC |
| 3992 | 6661 | CTTCGTTTCCCACTTTGTAA | 2 | NC | NC | NC |
| 3993 | 6662 | CCTTCGTTTCCCACTTTGTA | 2 | NC | NC | NC |
| 3994 | 6663 | ACCTTCGTTTCCCACTTTGT | 2 | NC | NC | NC |
| 3995 | 6664 | AACCTTCGTTTCCCACTTTG | 2 | NC | NC | NC |
| 3996 | 6665 | GAACCTTCGTTTCCCACTTT | 2 | NC | NC | NC |
| 3997 | 6666 | GGAACCTTCGTTTCCCACTT | 2 | NC | NC | NC |
| 3998 | 6667 | AGGAACCTTCGTTTCCCACT | 2 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 3999 | 6668 | GAGGAACCTTCGTTTCCCAC | 2 | NC | NC | NC |
| 4000 | 6669 | AGAGGAACCTTCGTTTCCCA | 2 | NC | NC | NC |
| 4001 | 6670 | AAGAGGAACCTTCGTTTCCC | 2 | NC | NC | NC |
| 4002 | 6671 | TAAGAGGAACCTTCGTTTCC | 2 | NC | NC | NC |
| 4003 | 6672 | CTAAGAGGAACCTTCGTTTC | 2 | NC | NC | NC |
| 4004 | 6673 | CCTAAGAGGAACCTTCGTTT | 2 | NC | NC | NC |
| 4005 | 6684 | ACAACTAGGTTCCTAAGAGG | 1 | NC | NC | NC |
| 4006 | 6685 | GACAACTAGGTTCCTAAGAG | 2 | NC | NC | NC |
| 4007 | 6686 | TGACAACTAGGTTCCTAAGA | 2 | NC | NC | NC |
| 4008 | 6687 | GTGACAACTAGGTTCCTAAG | 2 | NC | NC | NC |
| 4009 | 6688 | GGTGACAACTAGGTTCCTAA | 2 | NC | NC | NC |
| 4010 | 6689 | AGGTGACAACTAGGTTCCTA | 2 | NC | NC | NC |
| 4011 | 6690 | AAGGTGACAACTAGGTTCCT | 2 | NC | NC | NC |
| 4012 | 6691 | AAAGGTGACAACTAGGTTCC | 2 | NC | NC | NC |
| 4013 | 6692 | CAAAGGTGACAACTAGGTTC | 2 | NC | NC | NC |
| 4014 | 6693 | ACAAAGGTGACAACTAGGTT | 2 | NC | NC | NC |
| 4015 | 6694 | TACAAAGGTGACAACTAGGT | 2 | NC | NC | NC |
| 4016 | 6695 | ATACAAAGGTGACAACTAGG | 2 | NC | NC | NC |
| 4017 | 6696 | TATACAAAGGTGACAACTAG | 2 | NC | NC | NC |
| 4018 | 6697 | TTATACAAAGGTGACAACTA | 2 | NC | NC | NC |
| 4019 | 6698 | ATTATACAAAGGTGACAACT | 2 | NC | NC | NC |
| 4020 | 6699 | TATTATACAAAGGTGACAAC | 2 | NC | NC | NC |
| 4021 | 6700 | TTATTATACAAAGGTGACAA | 2 | NC | NC | NC |
| 4022 | 6701 | TTTATTATACAAAGGTGACA | 2 | NC | NC | NC |
| 4023 | 6702 | TTTTATTATACAAAGGTGAC | 2 | NC | NC | NC |
| 4024 | 6703 | GTTTTATTATACAAAGGTGA | 2 | NC | NC | NC |
| 4025 | 6704 | AGTTTTATTATACAAAGGTG | 2 | NC | NC | NC |
| 4026 | 6706 | GAAGTTTTATTATACAAAGG | 2 | NC | NC | NC |
| 4027 | 6707 | CGAAGTTTTATTATACAAAG | 2 | NC | NC | NC |
| 4028 | 6710 | CTTCGAAGTTTTATTATACA | 2 | NC | NC | NC |
| 4029 | 6711 | GCTTCGAAGTTTTATTATAC | 2 | NC | NC | NC |
| 4030 | 6712 | AGCTTCGAAGTTTTATTATA | 2 | NC | NC | NC |
| 4031 | 6713 | GAGCTTCGAAGTTTTATTAT | 2 | NC | NC | NC |
| 4032 | 6730 | AACCAGTTAACAGCTCCGAG | 2 | NC | NC | NC |
| 4033 | 6731 | AAACCAGTTAACAGCTCCGA | 2 | NC | NC | NC |
| 4034 | 6732 | CAAACCAGTTAACAGCTCCG | 2 | NC | NC | NC |
| 4035 | 6733 | GCAAACCAGTTAACAGCTCC | 2 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 4036 | 6734 | AGCAAACCAGTTAACAGCTC | 2 | NC | NC | NC |
| 4037 | 6735 | CAGCAAACCAGTTAACAGCT | 2 | NC | NC | NC |
| 4038 | 6736 | TCAGCAAACCAGTTAACAGC | 2 | NC | NC | NC |
| 4039 | 6737 | TTCAGCAAACCAGTTAACAG | 1 | NC | NC | NC |
| 4040 | 6738 | CTTCAGCAAACCAGTTAACA | 2 | NC | NC | NC |
| 4041 | 6739 | CCTTCAGCAAACCAGTTAAC | 2 | NC | NC | NC |
| 4042 | 6752 | TCTTACAGCTAAGCCTTCAG | 1 | NC | NC | NC |
| 4043 | 6753 | CTCTTACAGCTAAGCCTTCA | 1 | NC | NC | NC |
| 4044 | 6765 | TCTGAATTCTGGCTCTTACA | 1 | NC | NC | NC |
| 4045 | 6766 | GTCTGAATTCTGGCTCTTAC | 1 | NC | NC | NC |
| 4046 | 6767 | GGTCTGAATTCTGGCTCTTA | 1 | NC | NC | NC |
| 4047 | 6768 | GGGTCTGAATTCTGGCTCTT | 1 | NC | NC | NC |
| 4048 | 6769 | TGGGTCTGAATTCTGGCTCT | 0 | NC | NC | NC |
| 4049 | 6770 | CTGGGTCTGAATTCTGGCTC | 0 | NC | NC | NC |
| 4050 | 6771 | CCTGGGTCTGAATTCTGGCT | 0 | NC | NC | NC |
| 4051 | 6772 | ACCTGGGTCTGAATTCTGGC | 1 | NC | NC | NC |
| 4052 | 6791 | GCAGTTTGAAGTCACTCAGA | 2 | NC | NC | NC |
| 4053 | 6792 | TGCAGTTTGAAGTCACTCAG | 2 | NC | NC | NC |
| 4054 | 6793 | GTGCAGTTTGAAGTCACTCA | 2 | NC | NC | NC |
| 4055 | 6794 | TGTGCAGTTTGAAGTCACTC | 2 | NC | NC | NC |
| 4056 | 6795 | CTGTGCAGTTTGAAGTCACT | 2 | NC | NC | NC |
| 4057 | 6796 | ACTGTGCAGTTTGAAGTCAC | 2 | NC | NC | NC |
| 4058 | 6807 | TAATGGGAAGGACTGTGCAG | 2 | NC | NC | NC |
| 4059 | 6808 | ATAATGGGAAGGACTGTGCA | 2 | NC | NC | NC |
| 4060 | 6809 | AATAATGGGAAGGACTGTGC | 1 | NC | NC | NC |
| 4061 | 6810 | TAATAATGGGAAGGACTGTG | 2 | NC | NC | NC |
| 4062 | 6811 | GTAATAATGGGAAGGACTGT | 1 | NC | NC | NC |
| 4063 | 6812 | GGTAATAATGGGAAGGACTG | 1 | NC | NC | NC |
| 4064 | 6813 | GGGTAATAATGGGAAGGACT | 1 | NC | NC | NC |
| 4065 | 6814 | TGGGTAATAATGGGAAGGAC | 2 | NC | NC | NC |
| 4066 | 6815 | ATGGGTAATAATGGGAAGGA | 2 | NC | NC | NC |
| 4067 | 6816 | TATGGGTAATAATGGGAAGG | 2 | NC | NC | NC |
| 4068 | 6817 | ATATGGGTAATAATGGGAAG | 2 | NC | NC | NC |
| 4069 | 6818 | CATATGGGTAATAATGGGAA | 2 | NC | NC | NC |
| 4070 | 6819 | GCATATGGGTAATAATGGGA | 2 | NC | NC | NC |
| 4071 | 6820 | AGCATATGGGTAATAATGGG | 2 | NC | NC | NC |
| 4072 | 6821 | TAGCATATGGGTAATAATGG | 2 | NC | NC | NC |

TABLE 2-continued

| Exemplary Oligonucleotides | | | | | | |
|---|---|---|---|---|---|---|
| SEQ | | | Off-target Score | | | |
| ID NO | Position | Sequence | Human | Cyno | Mouse | Rat |
| 4073 | 6822 | ATAGCATATGGGTAATAATG | 2 | NC | NC | NC |
| 4074 | 6823 | GATAGCATATGGGTAATAAT | 2 | NC | NC | NC |
| 4075 | 6824 | GGATAGCATATGGGTAATAA | 3 | NC | NC | NC |
| 4076 | 6825 | GGGATAGCATATGGGTAATA | 2 | NC | NC | NC |
| 4077 | 6826 | AGGGATAGCATATGGGTAAT | 3 | NC | NC | NC |
| 4078 | 6827 | AAGGGATAGCATATGGGTAA | 2 | NC | NC | NC |
| 4079 | 6828 | TAAGGGATAGCATATGGGTA | 2 | NC | NC | NC |
| 4080 | 6829 | ATAAGGGATAGCATATGGGT | 3 | NC | NC | NC |
| 4081 | 6830 | TATAAGGGATAGCATATGGG | 2 | NC | NC | NC |
| 4082 | 6831 | ATATAAGGGATAGCATATGG | 2 | NC | NC | NC |
| 4083 | 6832 | AATATAAGGGATAGCATATG | 2 | NC | NC | NC |
| 4084 | 6833 | AAATATAAGGGATAGCATAT | 2 | NC | NC | NC |
| 4085 | 6834 | AAAATATAAGGGATAGCATA | 2 | NC | NC | NC |
| 4086 | 6835 | AAAAATATAAGGGATAGCAT | 1 | NC | NC | NC |
| 4087 | 6836 | TAAAAATATAAGGGATAGCA | 2 | NC | NC | NC |
| 4088 | 6837 | TTAAAAATATAAGGGATAGC | 1 | NC | NC | NC |
| 4089 | 6869 | CCAAGTTTATAAATGAATGA | 1 | NC | NC | NC |
| 4090 | 6870 | ACCAAGTTTATAAATGAATG | 1 | NC | NC | NC |
| 4091 | 6871 | CACCAAGTTTATAAATGAAT | 1 | NC | NC | NC |
| 4092 | 6872 | TCACCAAGTTTATAAATGAA | 1 | NC | NC | NC |
| 4093 | 6873 | ATCACCAAGTTTATAAATGA | 2 | NC | NC | NC |
| 4094 | 6874 | AATCACCAAGTTTATAAATG | 1 | NC | NC | NC |
| 4095 | 6875 | GAATCACCAAGTTTATAAAT | 1 | NC | NC | NC |
| 4096 | 6876 | TGAATCACCAAGTTTATAAA | 1 | NC | NC | NC |
| 4097 | 6877 | GTGAATCACCAAGTTTATAA | 2 | NC | NC | NC |
| 4098 | 6888 | ATCTAATAAAGGTGAATCAC | 2 | NC | NC | NC |
| 4099 | 6889 | AATCTAATAAAGGTGAATCA | 2 | NC | NC | NC |
| 4100 | 6890 | GAATCTAATAAAGGTGAATC | 2 | NC | NC | NC |
| 4101 | 6891 | AGAATCTAATAAAGGTGAAT | 2 | NC | NC | NC |
| 4102 | 6892 | CAGAATCTAATAAAGGTGAA | 1 | NC | NC | NC |
| 4103 | 6893 | CCAGAATCTAATAAAGGTGA | 2 | NC | NC | NC |
| 4104 | 6894 | ACCAGAATCTAATAAAGGTG | 2 | NC | NC | NC |
| 4105 | 6895 | GACCAGAATCTAATAAAGGT | 2 | NC | NC | NC |
| 4106 | 6896 | CGACCAGAATCTAATAAAGG | 2 | NC | NC | NC |
| 4107 | 6897 | GCGACCAGAATCTAATAAAG | 2 | NC | NC | NC |
| 4108 | 6898 | AGCGACCAGAATCTAATAAA | 3 | NC | NC | NC |
| 4109 | 6899 | CAGCGACCAGAATCTAATAA | 3 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 4110 | 6900 | TCAGCGACCAGAATCTAATA | 2 | NC | NC | NC |
| 4111 | 6901 | TTCAGCGACCAGAATCTAAT | 2 | NC | NC | NC |
| 4112 | 6902 | CTTCAGCGACCAGAATCTAA | 2 | NC | NC | NC |
| 4113 | 6903 | CCTTCAGCGACCAGAATCTA | 1 | NC | NC | NC |
| 4114 | 6904 | GCCTTCAGCGACCAGAATCT | 2 | NC | NC | NC |
| 4115 | 6916 | GAAGTTACTAAAGCCTTCAG | 1 | NC | NC | NC |
| 4116 | 6918 | CTGAAGTTACTAAAGCCTTC | 2 | NC | NC | NC |
| 4117 | 6919 | TCTGAAGTTACTAAAGCCTT | 2 | NC | NC | NC |
| 4118 | 6920 | CTCTGAAGTTACTAAAGCCT | 2 | NC | NC | NC |
| 4119 | 6921 | ACTCTGAAGTTACTAAAGCC | 2 | NC | NC | NC |
| 4120 | 6922 | TACTCTGAAGTTACTAAAGC | 2 | NC | NC | NC |
| 4121 | 6923 | TTACTCTGAAGTTACTAAAG | 1 | NC | NC | NC |
| 4122 | 6924 | TTTACTCTGAAGTTACTAAA | 1 | NC | NC | NC |
| 4123 | 6925 | TTTTACTCTGAAGTTACTAA | 1 | NC | NC | NC |
| 4124 | 6926 | GTTTTACTCTGAAGTTACTA | 2 | NC | NC | NC |
| 4125 | 6927 | AGTTTTACTCTGAAGTTACT | 2 | NC | NC | NC |
| 4126 | 6928 | AAGTTTTACTCTGAAGTTAC | 2 | NC | NC | NC |
| 4127 | 6929 | CAAGTTTTACTCTGAAGTTA | 2 | NC | NC | NC |
| 4128 | 6930 | TCAAGTTTTACTCTGAAGTT | 2 | NC | NC | NC |
| 4129 | 6932 | TCTCAAGTTTTACTCTGAAG | 1 | NC | NC | NC |
| 4130 | 6933 | CTCTCAAGTTTTACTCTGAA | 2 | NC | NC | NC |
| 4131 | 6934 | TCTCTCAAGTTTTACTCTGA | 2 | NC | NC | NC |
| 4132 | 6935 | ATCTCTCAAGTTTTACTCTG | 1 | NC | NC | NC |
| 4133 | 6936 | CATCTCTCAAGTTTTACTCT | 2 | NC | NC | NC |
| 4134 | 6937 | TCATCTCTCAAGTTTTACTC | 2 | NC | NC | NC |
| 4135 | 6938 | CTCATCTCTCAAGTTTTACT | 2 | NC | NC | NC |
| 4136 | 6939 | TCTCATCTCTCAAGTTTTAC | 2 | NC | NC | NC |
| 4137 | 6940 | ATCTCATCTCTCAAGTTTTA | 2 | NC | NC | NC |
| 4138 | 6941 | CATCTCATCTCTCAAGTTTT | 1 | NC | NC | NC |
| 4139 | 6942 | ACATCTCATCTCTCAAGTTT | 2 | NC | NC | NC |
| 4140 | 6943 | TACATCTCATCTCTCAAGTT | 2 | NC | NC | NC |
| 4141 | 6944 | TTACATCTCATCTCTCAAGT | 1 | NC | NC | NC |
| 4142 | 6945 | TTTACATCTCATCTCTCAAG | 1 | NC | NC | NC |
| 4143 | 6946 | TTTTACATCTCATCTCTCAA | 2 | NC | NC | NC |
| 4144 | 6947 | ATTTTACATCTCATCTCTCA | 1 | NC | NC | NC |
| 4145 | 6948 | CATTTTACATCTCATCTCTC | 1 | NC | NC | NC |
| 4146 | 6949 | GCATTTTACATCTCATCTCT | 2 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 4147 | 6950 | TGCATTTTACATCTCATCTC | 1 | NC | NC | NC |
| 4148 | 6951 | CTGCATTTTACATCTCATCT | 2 | NC | NC | NC |
| 4149 | 6952 | GCTGCATTTTACATCTCATC | 2 | NC | NC | NC |
| 4150 | 6953 | GGCTGCATTTTACATCTCAT | 2 | NC | NC | NC |
| 4151 | 6954 | TGGCTGCATTTTACATCTCA | 2 | NC | NC | NC |
| 4152 | 6955 | ATGGCTGCATTTTACATCTC | 2 | NC | NC | NC |
| 4153 | 6956 | AATGGCTGCATTTTACATCT | 2 | NC | NC | NC |
| 4154 | 6957 | GAATGGCTGCATTTTACATC | 2 | NC | NC | NC |
| 4155 | 6958 | AGAATGGCTGCATTTTACAT | 2 | NC | NC | NC |
| 4156 | 6959 | AAGAATGGCTGCATTTTACA | 1 | NC | NC | NC |
| 4157 | 6960 | CAAGAATGGCTGCATTTTAC | 2 | NC | NC | NC |
| 4158 | 6961 | TCAAGAATGGCTGCATTTTA | 1 | NC | NC | NC |
| 4159 | 6962 | CTCAAGAATGGCTGCATTTT | 1 | NC | NC | NC |
| 4160 | 6963 | TCTCAAGAATGGCTGCATTT | 2 | NC | NC | NC |
| 4161 | 6964 | CTCTCAAGAATGGCTGCATT | 2 | NC | NC | NC |
| 4162 | 6965 | ACTCTCAAGAATGGCTGCAT | 2 | NC | NC | NC |
| 4163 | 6966 | AACTCTCAAGAATGGCTGCA | 1 | NC | NC | NC |
| 4164 | 6967 | GAACTCTCAAGAATGGCTGC | 2 | NC | NC | NC |
| 4165 | 6968 | GGAACTCTCAAGAATGGCTG | 2 | NC | NC | NC |
| 4166 | 6969 | AGGAACTCTCAAGAATGGCT | 2 | NC | NC | NC |
| 4167 | 6970 | AAGGAACTCTCAAGAATGGC | 2 | NC | NC | NC |
| 4168 | 6971 | AAAGGAACTCTCAAGAATGG | 2 | NC | NC | NC |
| 4169 | 6972 | AAAAGGAACTCTCAAGAATG | 2 | NC | NC | NC |
| 4170 | 6973 | AAAAAGGAACTCTCAAGAAT | 2 | NC | NC | NC |
| 4171 | 6974 | GAAAAAGGAACTCTCAAGAA | 2 | NC | NC | NC |
| 4172 | 6975 | AGAAAAAGGAACTCTCAAGA | 2 | NC | NC | NC |
| 4173 | 6976 | CAGAAAAAGGAACTCTCAAG | 1 | NC | NC | NC |
| 4174 | 6977 | ACAGAAAAAGGAACTCTCAA | 1 | NC | NC | NC |
| 4175 | 6978 | TACAGAAAAAGGAACTCTCA | 1 | NC | NC | NC |
| 4176 | 6979 | TTACAGAAAAAGGAACTCTC | 2 | NC | NC | NC |
| 4177 | 6980 | GTTACAGAAAAAGGAACTCT | 1 | NC | NC | NC |
| 4178 | 6981 | TGTTACAGAAAAAGGAACTC | 2 | NC | NC | NC |
| 4179 | 6983 | AATGTTACAGAAAAAGGAAC | 1 | NC | NC | NC |
| 4180 | 6984 | GAATGTTACAGAAAAAGGAA | 1 | NC | NC | NC |
| 4181 | 6985 | TGAATGTTACAGAAAAAGGA | 1 | NC | NC | NC |
| 4182 | 6986 | ATGAATGTTACAGAAAAAGG | 2 | NC | NC | NC |
| 4183 | 6987 | GATGAATGTTACAGAAAAAG | 2 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 4184 | 6988 | TGATGAATGTTACAGAAAAA | 1 | NC | NC | NC |
| 4185 | 6989 | TTGATGAATGTTACAGAAAA | 1 | NC | NC | NC |
| 4186 | 6990 | GTTGATGAATGTTACAGAAA | 1 | NC | NC | NC |
| 4187 | 6991 | TGTTGATGAATGTTACAGAA | 1 | NC | NC | NC |
| 4188 | 6992 | GTGTTGATGAATGTTACAGA | 2 | NC | NC | NC |
| 4189 | 6993 | AGTGTTGATGAATGTTACAG | 2 | NC | NC | NC |
| 4190 | 6994 | AAGTGTTGATGAATGTTACA | 2 | NC | NC | NC |
| 4191 | 6995 | GAAGTGTTGATGAATGTTAC | 2 | NC | NC | NC |
| 4192 | 6996 | TGAAGTGTTGATGAATGTTA | 2 | NC | NC | NC |
| 4193 | 6997 | ATGAAGTGTTGATGAATGTT | 1 | NC | NC | NC |
| 4194 | 6998 | AATGAAGTGTTGATGAATGT | 1 | NC | NC | NC |
| 4195 | 6999 | CAATGAAGTGTTGATGAATG | 1 | NC | NC | NC |
| 4196 | 7000 | TCAATGAAGTGTTGATGAAT | 1 | NC | NC | NC |
| 4197 | 7001 | CTCAATGAAGTGTTGATGAA | 1 | NC | NC | NC |
| 4198 | 7002 | TCTCAATGAAGTGTTGATGA | 2 | NC | NC | NC |
| 4199 | 7003 | TTCTCAATGAAGTGTTGATG | 2 | NC | NC | NC |
| 4200 | 7012 | AACCTTCACTTCTCAATGAA | 2 | NC | NC | NC |
| 4201 | 7013 | GAACCTTCACTTCTCAATGA | 2 | NC | NC | NC |
| 4202 | 7014 | GGAACCTTCACTTCTCAATG | 2 | NC | NC | NC |
| 4203 | 7015 | AGGAACCTTCACTTCTCAAT | 2 | NC | NC | NC |
| 4204 | 7016 | TAGGAACCTTCACTTCTCAA | 2 | NC | NC | NC |
| 4205 | 7017 | ATAGGAACCTTCACTTCTCA | 2 | NC | NC | NC |
| 4206 | 7018 | CATAGGAACCTTCACTTCTC | 2 | NC | NC | NC |
| 4207 | 7019 | CCATAGGAACCTTCACTTCT | 2 | NC | NC | NC |
| 4208 | 7020 | GCCATAGGAACCTTCACTTC | 2 | NC | NC | NC |
| 4209 | 7021 | AGCCATAGGAACCTTCACTT | 2 | NC | NC | NC |
| 4210 | 7022 | CAGCCATAGGAACCTTCACT | 2 | NC | NC | NC |
| 4211 | 7023 | ACAGCCATAGGAACCTTCAC | 2 | NC | NC | NC |
| 4212 | 7024 | GACAGCCATAGGAACCTTCA | 3 | NC | NC | NC |
| 4213 | 7025 | AGACAGCCATAGGAACCTTC | 2 | NC | NC | NC |
| 4214 | 7026 | GAGACAGCCATAGGAACCTT | 2 | NC | NC | NC |
| 4215 | 7027 | AGAGACAGCCATAGGAACCT | 2 | NC | NC | NC |
| 4216 | 7028 | TAGAGACAGCCATAGGAACC | 2 | NC | NC | NC |
| 4217 | 7029 | GTAGAGACAGCCATAGGAAC | 2 | NC | NC | NC |
| 4218 | 7030 | GGTAGAGACAGCCATAGGAA | 1 | NC | NC | NC |
| 4219 | 7031 | AGGTAGAGACAGCCATAGGA | 2 | NC | NC | NC |
| 4220 | 7032 | AAGGTAGAGACAGCCATAGG | 2 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 4221 | 7033 | GAAGGTAGAGACAGCCATAG | 1 | NC | NC | NC |
| 4222 | 7034 | TGAAGGTAGAGACAGCCATA | 2 | NC | NC | NC |
| 4223 | 7035 | TTGAAGGTAGAGACAGCCAT | 2 | NC | NC | NC |
| 4224 | 7036 | CTTGAAGGTAGAGACAGCCA | 2 | NC | NC | NC |
| 4225 | 7037 | TCTTGAAGGTAGAGACAGCC | 2 | NC | NC | NC |
| 4226 | 7049 | TAAAGCTAAGCCTCTTGAAG | 1 | NC | NC | NC |
| 4227 | 7050 | CTAAAGCTAAGCCTCTTGAA | 0 | NC | NC | NC |
| 4228 | 7051 | ACTAAAGCTAAGCCTCTTGA | 1 | NC | NC | NC |
| 4229 | 7052 | GACTAAAGCTAAGCCTCTTG | 2 | NC | NC | NC |
| 4230 | 7053 | TGACTAAAGCTAAGCCTCTT | 2 | NC | NC | NC |
| 4231 | 7054 | GTGACTAAAGCTAAGCCTCT | 2 | NC | NC | NC |
| 4232 | 7055 | AGTGACTAAAGCTAAGCCTC | 2 | NC | NC | NC |
| 4233 | 7056 | CAGTGACTAAAGCTAAGCCT | 1 | NC | NC | NC |
| 4234 | 7057 | TCAGTGACTAAAGCTAAGCC | 2 | NC | NC | NC |
| 4235 | 7058 | CTCAGTGACTAAAGCTAAGC | 1 | NC | NC | NC |
| 4236 | 7059 | TCTCAGTGACTAAAGCTAAG | 1 | NC | NC | NC |
| 4237 | 7060 | TTCTCAGTGACTAAAGCTAA | 2 | NC | NC | NC |
| 4238 | 7061 | TTTCTCAGTGACTAAAGCTA | 1 | NC | NC | NC |
| 4239 | 7062 | CTTTCTCAGTGACTAAAGCT | 2 | NC | NC | NC |
| 4240 | 7063 | TCTTTCTCAGTGACTAAAGC | 2 | NC | NC | NC |
| 4241 | 7064 | GTCTTTCTCAGTGACTAAAG | 2 | NC | NC | NC |
| 4242 | 7065 | TGTCTTTCTCAGTGACTAAA | 2 | NC | NC | NC |
| 4243 | 7066 | TTGTCTTTCTCAGTGACTAA | 2 | NC | NC | NC |
| 4244 | 7067 | CTTGTCTTTCTCAGTGACTA | 1 | NC | NC | NC |
| 4245 | 7068 | CCTTGTCTTTCTCAGTGACT | 2 | NC | NC | NC |
| 4246 | 7069 | TCCTTGTCTTTCTCAGTGAC | 2 | NC | NC | NC |
| 4247 | 7070 | TTCCTTGTCTTTCTCAGTGA | 2 | NC | NC | NC |
| 4248 | 7071 | TTTCCTTGTCTTTCTCAGTG | 2 | NC | NC | NC |
| 4249 | 7072 | GTTTCCTTGTCTTTCTCAGT | 1 | NC | NC | NC |
| 4250 | 7073 | AGTTTCCTTGTCTTTCTCAG | 1 | NC | NC | NC |
| 4251 | 7074 | TAGTTTCCTTGTCTTTCTCA | 1 | NC | NC | NC |
| 4252 | 7075 | TTAGTTTCCTTGTCTTTCTC | 1 | NC | NC | NC |
| 4253 | 7076 | ATTAGTTTCCTTGTCTTTCT | 1 | NC | NC | NC |
| 4254 | 7077 | CATTAGTTTCCTTGTCTTTC | 1 | NC | NC | NC |
| 4255 | 7078 | TCATTAGTTTCCTTGTCTTT | 1 | NC | NC | NC |
| 4256 | 7079 | ATCATTAGTTTCCTTGTCTT | 2 | NC | NC | NC |
| 4257 | 7080 | TATCATTAGTTTCCTTGTCT | 2 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 4258 | 7081 | CTATCATTAGTTTCCTTGTC | 2 | NC | NC | NC |
| 4259 | 7082 | TCTATCATTAGTTTCCTTGT | 2 | NC | NC | NC |
| 4260 | 7083 | TTCTATCATTAGTTTCCTTG | 2 | NC | NC | NC |
| 4261 | 7084 | ATTCTATCATTAGTTTCCTT | 1 | NC | NC | NC |
| 4262 | 7085 | TATTCTATCATTAGTTTCCT | 2 | NC | NC | NC |
| 4263 | 7086 | ATATTCTATCATTAGTTTCC | 2 | NC | NC | NC |
| 4264 | 7091 | CTACTATATTCTATCATTAG | 2 | NC | NC | NC |
| 4265 | 7092 | GCTACTATATTCTATCATTA | 2 | NC | NC | NC |
| 4266 | 7093 | AGCTACTATATTCTATCATT | 1 | NC | NC | NC |
| 4267 | 7094 | AAGCTACTATATTCTATCAT | 1 | NC | NC | NC |
| 4268 | 7095 | GAAGCTACTATATTCTATCA | 2 | NC | NC | NC |
| 4269 | 7096 | AGAAGCTACTATATTCTATC | 2 | NC | NC | NC |
| 4270 | 7097 | AAGAAGCTACTATATTCTAT | 2 | NC | NC | NC |
| 4271 | 7098 | GAAGAAGCTACTATATTCTA | 2 | NC | NC | NC |
| 4272 | 7099 | AGAAGAAGCTACTATATTCT | 2 | NC | NC | NC |
| 4273 | 7100 | CAGAAGAAGCTACTATATTC | 1 | NC | NC | NC |
| 4274 | 7101 | CCAGAAGAAGCTACTATATT | 1 | NC | NC | NC |
| 4275 | 7102 | GCCAGAAGAAGCTACTATAT | 2 | NC | NC | NC |
| 4276 | 7103 | CGCCAGAAGAAGCTACTATA | 1 | NC | NC | NC |
| 4277 | 7104 | ACGCCAGAAGAAGCTACTAT | 2 | NC | NC | NC |
| 4278 | 7105 | AACGCCAGAAGAAGCTACTA | 3 | NC | NC | NC |
| 4279 | 7106 | TAACGCCAGAAGAAGCTACT | 2 | NC | NC | NC |
| 4280 | 7107 | CTAACGCCAGAAGAAGCTAC | 2 | NC | NC | NC |
| 4281 | 7108 | CCTAACGCCAGAAGAAGCTA | 3 | NC | NC | NC |
| 4282 | 7109 | ACCTAACGCCAGAAGAAGCT | 2 | NC | NC | NC |
| 4283 | 7110 | TACCTAACGCCAGAAGAAGC | 3 | NC | NC | NC |
| 4284 | 7111 | ATACCTAACGCCAGAAGAAG | 2 | NC | NC | NC |
| 4285 | 7112 | GATACCTAACGCCAGAAGAA | 3 | NC | NC | NC |
| 4286 | 7113 | TGATACCTAACGCCAGAAGA | 2 | NC | NC | NC |
| 4287 | 7114 | GTGATACCTAACGCCAGAAG | 3 | NC | NC | NC |
| 4288 | 7115 | TGTGATACCTAACGCCAGAA | 2 | NC | NC | NC |
| 4289 | 7116 | CTGTGATACCTAACGCCAGA | 2 | NC | NC | NC |
| 4290 | 7117 | TCTGTGATACCTAACGCCAG | 3 | NC | NC | NC |
| 4291 | 7118 | CTCTGTGATACCTAACGCCA | 2 | NC | NC | NC |
| 4292 | 7119 | ACTCTGTGATACCTAACGCC | 2 | NC | NC | NC |
| 4293 | 7120 | GACTCTGTGATACCTAACGC | 2 | NC | NC | NC |
| 4294 | 7121 | TGACTCTGTGATACCTAACG | 2 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 4295 | 7122 | GTGACTCTGTGATACCTAAC | 2 | NC | NC | NC |
| 4296 | 7123 | TGTGACTCTGTGATACCTAA | 2 | NC | NC | NC |
| 4297 | 7124 | CTGTGACTCTGTGATACCTA | 2 | NC | NC | NC |
| 4298 | 7125 | GCTGTGACTCTGTGATACCT | 2 | NC | NC | NC |
| 4299 | 7126 | AGCTGTGACTCTGTGATACC | 2 | NC | NC | NC |
| 4300 | 7127 | TAGCTGTGACTCTGTGATAC | 2 | NC | NC | NC |
| 4301 | 7128 | CTAGCTGTGACTCTGTGATA | 2 | NC | NC | NC |
| 4302 | 7129 | ACTAGCTGTGACTCTGTGAT | 1 | NC | NC | NC |
| 4303 | 7130 | AACTAGCTGTGACTCTGTGA | 2 | NC | NC | NC |
| 4304 | 7131 | TAACTAGCTGTGACTCTGTG | 2 | NC | NC | NC |
| 4305 | 7132 | GTAACTAGCTGTGACTCTGT | 2 | NC | NC | NC |
| 4306 | 7133 | TGTAACTAGCTGTGACTCTG | 2 | NC | NC | NC |
| 4307 | 7134 | CTGTAACTAGCTGTGACTCT | 2 | NC | NC | NC |
| 4308 | 7145 | TAAAGGGCTAGCTGTAACTA | 3 | NC | NC | NC |
| 4309 | 7146 | ATAAAGGGCTAGCTGTAACT | 2 | NC | NC | NC |
| 4310 | 7147 | AATAAAGGGCTAGCTGTAAC | 3 | NC | NC | NC |
| 4311 | 7148 | TAATAAAGGGCTAGCTGTAA | 2 | NC | NC | NC |
| 4312 | 7149 | ATAATAAAGGGCTAGCTGTA | 2 | NC | NC | NC |
| 4313 | 7150 | AATAATAAAGGGCTAGCTGT | 2 | NC | NC | NC |
| 4314 | 7151 | CAATAATAAAGGGCTAGCTG | 2 | NC | NC | NC |
| 4315 | 7152 | TCAATAATAAAGGGCTAGCT | 1 | NC | NC | NC |
| 4316 | 7153 | TTCAATAATAAAGGGCTAGC | 1 | NC | NC | NC |
| 4317 | 7154 | TTTCAATAATAAAGGGCTAG | 1 | NC | NC | NC |
| 4318 | 7155 | CTTTCAATAATAAAGGGCTA | 2 | NC | NC | NC |
| 4319 | 7156 | TCTTTCAATAATAAAGGGCT | 2 | NC | NC | NC |
| 4320 | 7157 | TTCTTTCAATAATAAAGGGC | 1 | NC | NC | NC |
| 4321 | 7158 | CTTCTTTCAATAATAAAGGG | 2 | NC | NC | NC |
| 4322 | 7159 | TCTTCTTTCAATAATAAAGG | 1 | NC | NC | NC |
| 4323 | 7160 | CTCTTCTTTCAATAATAAAG | 2 | NC | NC | NC |
| 4324 | 7161 | CCTCTTCTTTCAATAATAAA | 2 | NC | NC | NC |
| 4325 | 7162 | TCCTCTTCTTTCAATAATAA | 2 | NC | NC | NC |
| 4326 | 7163 | CTCCTCTTCTTTCAATAATA | 1 | NC | NC | NC |
| 4327 | 7164 | GCTCCTCTTCTTTCAATAAT | 2 | NC | NC | NC |
| 4328 | 7165 | AGCTCCTCTTCTTTCAATAA | 2 | NC | NC | NC |
| 4329 | 7166 | TAGCTCCTCTTCTTTCAATA | 2 | NC | NC | NC |
| 4330 | 7167 | CTAGCTCCTCTTCTTTCAAT | 2 | NC | NC | NC |
| 4331 | 7168 | GCTAGCTCCTCTTCTTTCAA | 2 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 4332 | 7169 | TGCTAGCTCCTCTTCTTTCA | 2 | NC | NC | NC |
| 4333 | 7170 | CTGCTAGCTCCTCTTCTTTC | 1 | NC | NC | NC |
| 4334 | 7171 | ACTGCTAGCTCCTCTTCTTT | 1 | NC | NC | NC |
| 4335 | 7172 | GACTGCTAGCTCCTCTTCTT | 2 | NC | NC | NC |
| 4336 | 7173 | GGACTGCTAGCTCCTCTTCT | 2 | NC | NC | NC |
| 4337 | 7175 | TGGGACTGCTAGCTCCTCTT | 2 | NC | NC | NC |
| 4338 | 7178 | TAGTGGGACTGCTAGCTCCT | 2 | NC | NC | NC |
| 4339 | 7179 | ATAGTGGGACTGCTAGCTCC | 2 | NC | NC | NC |
| 4340 | 7180 | GATAGTGGGACTGCTAGCTC | 3 | NC | NC | NC |
| 4341 | 7181 | TGATAGTGGGACTGCTAGCT | 2 | NC | NC | NC |
| 4342 | 7182 | CTGATAGTGGGACTGCTAGC | 2 | NC | NC | NC |
| 4343 | 7183 | TCTGATAGTGGGACTGCTAG | 2 | NC | NC | NC |
| 4344 | 7184 | TTCTGATAGTGGGACTGCTA | 3 | NC | NC | NC |
| 4345 | 7185 | ATTCTGATAGTGGGACTGCT | 2 | NC | NC | NC |
| 4346 | 7186 | AATTCTGATAGTGGGACTGC | 2 | NC | NC | NC |
| 4347 | 7187 | TAATTCTGATAGTGGGACTG | 2 | NC | NC | NC |
| 4348 | 7188 | TTAATTCTGATAGTGGGACT | 3 | NC | NC | NC |
| 4349 | 7189 | CTTAATTCTGATAGTGGGAC | 3 | NC | NC | NC |
| 4350 | 7190 | TCTTAATTCTGATAGTGGGA | 2 | NC | NC | NC |
| 4351 | 7191 | GTCTTAATTCTGATAGTGGG | 2 | NC | NC | NC |
| 4352 | 7192 | AGTCTTAATTCTGATAGTGG | 1 | NC | NC | NC |
| 4353 | 7193 | TAGTCTTAATTCTGATAGTG | 1 | NC | NC | NC |
| 4354 | 7194 | CTAGTCTTAATTCTGATAGT | 2 | NC | NC | NC |
| 4355 | 7195 | TCTAGTCTTAATTCTGATAG | 2 | NC | NC | NC |
| 4356 | 7196 | CTCTAGTCTTAATTCTGATA | 2 | NC | NC | NC |
| 4357 | 7197 | TCTCTAGTCTTAATTCTGAT | 2 | NC | NC | NC |
| 4358 | 7198 | ATCTCTAGTCTTAATTCTGA | 2 | NC | NC | NC |
| 4359 | 7199 | CATCTCTAGTCTTAATTCTG | 2 | NC | NC | NC |
| 4360 | 7200 | CCATCTCTAGTCTTAATTCT | 2 | NC | NC | NC |
| 4361 | 7201 | ACCATCTCTAGTCTTAATTC | 2 | NC | NC | NC |
| 4362 | 7202 | TACCATCTCTAGTCTTAATT | 2 | NC | NC | NC |
| 4363 | 7203 | TTACCATCTCTAGTCTTAAT | 2 | NC | NC | NC |
| 4364 | 7204 | ATTACCATCTCTAGTCTTAA | 1 | NC | NC | NC |
| 4365 | 7205 | TATTACCATCTCTAGTCTTA | 1 | NC | NC | NC |
| 4366 | 7206 | CTATTACCATCTCTAGTCTT | 1 | NC | NC | NC |
| 4367 | 7207 | CCTATTACCATCTCTAGTCT | 2 | NC | NC | NC |
| 4368 | 7208 | TCCTATTACCATCTCTAGTC | 2 | NC | NC | NC |

TABLE 2-continued

| Exemplary Oligonucleotides | | | | | | |
|---|---|---|---|---|---|---|
| SEQ | | | Off-target Score | | | |
| ID NO | Position | Sequence | Human | Cyno | Mouse | Rat |
| 4369 | 7209 | CTCCTATTACCATCTCTAGT | 2 | NC | NC | NC |
| 4370 | 7210 | GCTCCTATTACCATCTCTAG | 2 | NC | NC | NC |
| 4371 | 7211 | AGCTCCTATTACCATCTCTA | 2 | NC | NC | NC |
| 4372 | 7212 | TAGCTCCTATTACCATCTCT | 1 | NC | NC | NC |
| 4373 | 7213 | CTAGCTCCTATTACCATCTC | 2 | NC | NC | NC |
| 4374 | 7214 | ACTAGCTCCTATTACCATCT | 2 | NC | NC | NC |
| 4375 | 7215 | TACTAGCTCCTATTACCATC | 2 | NC | NC | NC |
| 4376 | 7216 | ATACTAGCTCCTATTACCAT | 2 | NC | NC | NC |
| 4377 | 7217 | GATACTAGCTCCTATTACCA | 2 | NC | NC | NC |
| 4378 | 7218 | TGATACTAGCTCCTATTACC | 2 | NC | NC | NC |
| 4379 | 7219 | CTGATACTAGCTCCTATTAC | 2 | NC | NC | NC |
| 4380 | 7220 | TCTGATACTAGCTCCTATTA | 2 | NC | NC | NC |
| 4381 | 7221 | TTCTGATACTAGCTCCTATT | 1 | NC | NC | NC |
| 4382 | 7222 | TTTCTGATACTAGCTCCTAT | 2 | NC | NC | NC |
| 4383 | 7223 | TTTTCTGATACTAGCTCCTA | 2 | NC | NC | NC |
| 4384 | 7224 | CTTTTCTGATACTAGCTCCT | 2 | NC | NC | NC |
| 4385 | 7225 | GCTTTTCTGATACTAGCTCC | 2 | NC | NC | NC |
| 4386 | 7226 | AGCTTTTCTGATACTAGCTC | 2 | NC | NC | NC |
| 4387 | 7228 | TAAGCTTTTCTGATACTAGC | 2 | NC | NC | NC |
| 4388 | 7229 | TTAAGCTTTTCTGATACTAG | 1 | NC | NC | NC |
| 4389 | 7230 | CTTAAGCTTTTCTGATACTA | 1 | NC | NC | NC |
| 4390 | 7231 | CCTTAAGCTTTTCTGATACT | 2 | NC | NC | NC |
| 4391 | 7244 | ACTTTATGCTTTGCCTTAAG | 2 | NC | NC | NC |
| 4392 | 7245 | CACTTTATGCTTTGCCTTAA | 1 | NC | NC | NC |
| 4393 | 7246 | ACACTTTATGCTTTGCCTTA | 1 | NC | NC | NC |
| 4394 | 7247 | TACACTTTATGCTTTGCCTT | 2 | NC | NC | NC |
| 4395 | 7248 | CTACACTTTATGCTTTGCCT | 2 | NC | NC | NC |
| 4396 | 7249 | CCTACACTTTATGCTTTGCC | 2 | NC | NC | NC |
| 4397 | 7250 | GCCTACACTTTATGCTTTGC | 2 | NC | NC | NC |
| 4398 | 7251 | AGCCTACACTTTATGCTTTG | 2 | NC | NC | NC |
| 4399 | 7252 | TAGCCTACACTTTATGCTTT | 2 | NC | NC | NC |
| 4400 | 7253 | CTAGCCTACACTTTATGCTT | 3 | NC | NC | NC |
| 4401 | 7254 | TCTAGCCTACACTTTATGCT | 3 | NC | NC | NC |
| 4402 | 7255 | TTCTAGCCTACACTTTATGC | 2 | NC | NC | NC |
| 4403 | 7256 | ATTCTAGCCTACACTTTATG | 2 | NC | NC | NC |
| 4404 | 7257 | CATTCTAGCCTACACTTTAT | 2 | NC | NC | NC |
| 4405 | 7258 | TCATTCTAGCCTACACTTTA | 2 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 4406 | 7259 | TTCATTCTAGCCTACACTTT | 2 | NC | NC | NC |
| 4407 | 7260 | CTTCATTCTAGCCTACACTT | 2 | NC | NC | NC |
| 4408 | 7261 | GCTTCATTCTAGCCTACACT | 2 | NC | NC | NC |
| 4409 | 7269 | ATTCTCCAGCTTCATTCTAG | 1 | NC | NC | NC |
| 4410 | 7270 | CATTCTCCAGCTTCATTCTA | 1 | NC | NC | NC |
| 4411 | 7271 | CCATTCTCCAGCTTCATTCT | 1 | NC | NC | NC |
| 4412 | 7272 | CCCATTCTCCAGCTTCATTC | 1 | NC | NC | NC |
| 4413 | 7273 | CCCCATTCTCCAGCTTCATT | 1 | NC | NC | NC |
| 4414 | 7274 | TCCCCATTCTCCAGCTTCAT | 1 | NC | NC | NC |
| 4415 | 7275 | CTCCCCATTCTCCAGCTTCA | 1 | NC | NC | NC |
| 4416 | 7296 | TCTGGATGTTACCCAAGCCC | 2 | NC | NC | NC |
| 4417 | 7297 | TTCTGGATGTTACCCAAGCC | 2 | NC | NC | NC |
| 4418 | 7298 | GTTCTGGATGTTACCCAAGC | 2 | NC | NC | NC |
| 4419 | 7299 | GGTTCTGGATGTTACCCAAG | 2 | NC | NC | NC |
| 4420 | 7300 | AGGTTCTGGATGTTACCCAA | 2 | NC | NC | NC |
| 4421 | 7301 | CAGGTTCTGGATGTTACCCA | 2 | NC | NC | NC |
| 4422 | 7322 | ATGTAGTTCCAGGTCCCCAG | 1 | NC | NC | NC |
| 4423 | 7323 | CATGTAGTTCCAGGTCCCCA | 2 | NC | NC | NC |
| 4424 | 7324 | TCATGTAGTTCCAGGTCCCC | 2 | NC | NC | NC |
| 4425 | 7325 | CTCATGTAGTTCCAGGTCCC | 2 | NC | NC | NC |
| 4426 | 7326 | TCTCATGTAGTTCCAGGTCC | 3 | NC | NC | NC |
| 4427 | 7327 | ATCTCATGTAGTTCCAGGTC | 2 | NC | NC | NC |
| 4428 | 7328 | CATCTCATGTAGTTCCAGGT | 2 | NC | NC | NC |
| 4429 | 7339 | CTCCATTCTTACATCTCATG | 2 | NC | NC | NC |
| 4430 | 7340 | TCTCCATTCTTACATCTCAT | 1 | NC | NC | NC |
| 4431 | 7341 | CTCTCCATTCTTACATCTCA | 1 | NC | NC | NC |
| 4432 | 7342 | CCTCTCCATTCTTACATCTC | 1 | NC | NC | NC |
| 4433 | 7343 | ACCTCTCCATTCTTACATCT | 1 | NC | NC | NC |
| 4434 | 7344 | AACCTCTCCATTCTTACATC | 1 | NC | NC | NC |
| 4435 | 7345 | GAACCTCTCCATTCTTACAT | 0 | NC | NC | NC |
| 4436 | 7346 | AGAACCTCTCCATTCTTACA | 0 | NC | NC | NC |
| 4437 | 7347 | TAGAACCTCTCCATTCTTAC | 1 | NC | NC | NC |
| 4438 | 7348 | CTAGAACCTCTCCATTCTTA | 1 | NC | NC | NC |
| 4439 | 7349 | GCTAGAACCTCTCCATTCTT | 1 | NC | NC | NC |
| 4440 | 7351 | CTGCTAGAACCTCTCCATTC | 2 | NC | NC | NC |
| 4441 | 7352 | ACTGCTAGAACCTCTCCATT | 2 | NC | NC | NC |
| 4442 | 7353 | GACTGCTAGAACCTCTCCAT | 3 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 4443 | 7354 | TGACTGCTAGAACCTCTCCA | 2 | NC | NC | NC |
| 4444 | 7355 | CTGACTGCTAGAACCTCTCC | 2 | NC | NC | NC |
| 4445 | 7356 | TCTGACTGCTAGAACCTCTC | 2 | NC | NC | NC |
| 4446 | 7357 | CTCTGACTGCTAGAACCTCT | 2 | NC | NC | NC |
| 4447 | 7358 | CCTCTGACTGCTAGAACCTC | 2 | NC | NC | NC |
| 4448 | 7359 | ACCTCTGACTGCTAGAACCT | 2 | NC | NC | NC |
| 4449 | 7360 | GACCTCTGACTGCTAGAACC | 2 | NC | NC | NC |
| 4450 | 7361 | TGACCTCTGACTGCTAGAAC | 2 | NC | NC | NC |
| 4451 | 7362 | CTGACCTCTGACTGCTAGAA | 1 | NC | NC | NC |
| 4452 | 7363 | CCTGACCTCTGACTGCTAGA | 2 | NC | NC | NC |
| 4453 | 7364 | ACCTGACCTCTGACTGCTAG | 1 | NC | NC | NC |
| 4454 | 7365 | TACCTGACCTCTGACTGCTA | 2 | NC | NC | NC |
| 4455 | 7366 | GTACCTGACCTCTGACTGCT | 2 | NC | NC | NC |
| 4456 | 7367 | TGTACCTGACCTCTGACTGC | 2 | NC | NC | NC |
| 4457 | 7368 | TTGTACCTGACCTCTGACTG | 3 | NC | NC | NC |
| 4458 | 7369 | TTTGTACCTGACCTCTGACT | 2 | NC | NC | NC |
| 4459 | 7370 | ATTTGTACCTGACCTCTGAC | 2 | NC | NC | NC |
| 4460 | 7371 | CATTTGTACCTGACCTCTGA | 2 | NC | NC | NC |
| 4461 | 7372 | TCATTTGTACCTGACCTCTG | 1 | NC | NC | NC |
| 4462 | 7373 | TTCATTTGTACCTGACCTCT | 2 | NC | NC | NC |
| 4463 | 7374 | GTTCATTTGTACCTGACCTC | 2 | NC | NC | NC |
| 4464 | 7375 | TGTTCATTTGTACCTGACCT | 2 | NC | NC | NC |
| 4465 | 7376 | CTGTTCATTTGTACCTGACC | 2 | NC | NC | NC |
| 4466 | 7377 | GCTGTTCATTTGTACCTGAC | 2 | NC | NC | NC |
| 4467 | 7378 | AGCTGTTCATTTGTACCTGA | 2 | NC | NC | NC |
| 4468 | 7379 | CAGCTGTTCATTTGTACCTG | 2 | NC | NC | NC |
| 4469 | 7380 | CCAGCTGTTCATTTGTACCT | 1 | NC | NC | NC |
| 4470 | 7381 | CCCAGCTGTTCATTTGTACC | 1 | NC | NC | NC |
| 4471 | 7382 | TCCCAGCTGTTCATTTGTAC | 1 | NC | NC | NC |
| 4472 | 7383 | ATCCCAGCTGTTCATTTGTA | 1 | NC | NC | NC |
| 4473 | 7384 | GATCCCAGCTGTTCATTTGT | 2 | NC | NC | NC |
| 4474 | 7385 | AGATCCCAGCTGTTCATTTG | 2 | NC | NC | NC |
| 4475 | 7386 | CAGATCCCAGCTGTTCATTT | 2 | NC | NC | NC |
| 4476 | 7387 | GCAGATCCCAGCTGTTCATT | 2 | NC | NC | NC |
| 4477 | 7388 | CGCAGATCCCAGCTGTTCAT | 2 | NC | NC | NC |
| 4478 | 7391 | ATGCGCAGATCCCAGCTGTT | 2 | NC | NC | NC |
| 4479 | 7406 | TTTTCACTGTCTGCCATGCG | 2 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 4480 | 7407 | TTTTTCACTGTCTGCCATGC | 1 | NC | NC | NC |
| 4481 | 7423 | TTTTGCTTGCCTGGGTTTTT | 1 | NC | NC | NC |
| 4482 | 7424 | ATTTTGCTTGCCTGGGTTTT | 1 | NC | NC | NC |
| 4483 | 7425 | CATTTTGCTTGCCTGGGTTT | 2 | NC | NC | NC |
| 4484 | 7426 | CCATTTTGCTTGCCTGGGTT | 2 | NC | NC | NC |
| 4485 | 7427 | ACCATTTTGCTTGCCTGGGT | 2 | NC | NC | NC |
| 4486 | 7428 | GACCATTTTGCTTGCCTGGG | 2 | NC | NC | NC |
| 4487 | 7429 | TGACCATTTTGCTTGCCTGG | 1 | NC | NC | NC |
| 4488 | 7430 | CTGACCATTTTGCTTGCCTG | 2 | NC | NC | NC |
| 4489 | 7431 | TCTGACCATTTTGCTTGCCT | 1 | NC | NC | NC |
| 4490 | 7432 | CTCTGACCATTTTGCTTGCC | 1 | NC | NC | NC |
| 4491 | 7433 | GCTCTGACCATTTTGCTTGC | 2 | NC | NC | NC |
| 4492 | 7434 | TGCTCTGACCATTTTGCTTG | 2 | NC | NC | NC |
| 4493 | 7435 | CTGCTCTGACCATTTTGCTT | 2 | NC | NC | NC |
| 4494 | 7436 | TCTGCTCTGACCATTTTGCT | 2 | NC | NC | NC |
| 4495 | 7437 | TTCTGCTCTGACCATTTTGC | 2 | NC | NC | NC |
| 4496 | 7438 | TTTCTGCTCTGACCATTTTG | 2 | NC | NC | NC |
| 4497 | 7439 | CTTTCTGCTCTGACCATTTT | 2 | NC | NC | NC |
| 4498 | 7440 | CCTTTCTGCTCTGACCATTT | 2 | NC | NC | NC |
| 4499 | 7441 | CCCTTTCTGCTCTGACCATT | 2 | NC | NC | NC |
| 4500 | 7442 | CCCCTTTCTGCTCTGACCAT | 2 | NC | NC | NC |
| 4501 | 7465 | CATCTCAAGAACGTGGCCTT | 1 | NC | NC | NC |
| 4502 | 7466 | ACATCTCAAGAACGTGGCCT | 2 | NC | NC | NC |
| 4503 | 7467 | CACATCTCAAGAACGTGGCC | 3 | NC | NC | NC |
| 4504 | 7470 | CTCCACATCTCAAGAACGTG | 2 | NC | NC | NC |
| 4505 | 7471 | CCTCCACATCTCAAGAACGT | 2 | NC | NC | NC |
| 4506 | 7472 | CCCTCCACATCTCAAGAACG | 1 | NC | NC | NC |
| 4507 | 7473 | CCCCTCCACATCTCAAGAAC | 2 | NC | NC | NC |
| 4508 | 7474 | CCCCCTCCACATCTCAAGAA | 1 | NC | NC | NC |
| 4509 | 7495 | TACTTGGCGTGGCTTCCTCA | 2 | NC | NC | NC |
| 4510 | 7496 | TTACTTGGCGTGGCTTCCTC | 2 | NC | NC | NC |
| 4511 | 7497 | CTTACTTGGCGTGGCTTCCT | 2 | NC | NC | NC |
| 4512 | 7499 | TCCTTACTTGGCGTGGCTTC | 3 | NC | NC | NC |
| 4513 | 7500 | GTCCTTACTTGGCGTGGCTT | 3 | NC | NC | NC |
| 4514 | 7501 | TGTCCTTACTTGGCGTGGCT | 2 | NC | NC | NC |
| 4515 | 7503 | TCTGTCCTTACTTGGCGTGG | 2 | NC | NC | NC |
| 4516 | 7504 | ATCTGTCCTTACTTGGCGTG | 3 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 4517 | 7505 | CATCTGTCCTTACTTGGCGT | 3 | NC | NC | NC |
| 4518 | 7506 | GCATCTGTCCTTACTTGGCG | 2 | NC | NC | NC |
| 4519 | 7507 | TGCATCTGTCCTTACTTGGC | 2 | NC | NC | NC |
| 4520 | 7508 | CTGCATCTGTCCTTACTTGG | 2 | NC | NC | NC |
| 4521 | 7509 | GCTGCATCTGTCCTTACTTG | 2 | NC | NC | NC |
| 4522 | 7510 | AGCTGCATCTGTCCTTACTT | 2 | NC | NC | NC |
| 4523 | 7511 | GAGCTGCATCTGTCCTTACT | 1 | NC | NC | NC |
| 4524 | 7512 | TGAGCTGCATCTGTCCTTAC | 2 | NC | NC | NC |
| 4525 | 7513 | CTGAGCTGCATCTGTCCTTA | 2 | NC | NC | NC |
| 4526 | 7514 | GCTGAGCTGCATCTGTCCTT | 2 | NC | NC | NC |
| 4527 | 7515 | TGCTGAGCTGCATCTGTCCT | 1 | NC | NC | NC |
| 4528 | 7536 | TTGTCAGGGCTCGCTAGGAA | 3 | NC | NC | NC |
| 4529 | 7586 | ACTCCACTGTGCCATGACTG | 2 | NC | NC | NC |
| 4530 | 7587 | CACTCCACTGTGCCATGACT | 2 | NC | NC | NC |
| 4531 | 7588 | TCACTCCACTGTGCCATGAC | 2 | NC | NC | NC |
| 4532 | 7589 | TTCACTCCACTGTGCCATGA | 2 | NC | NC | NC |
| 4533 | 7590 | CTTCACTCCACTGTGCCATG | 2 | NC | NC | NC |
| 4534 | 7591 | CCTTCACTCCACTGTGCCAT | 1 | NC | NC | NC |
| 4535 | 7592 | TCCTTCACTCCACTGTGCCA | 1 | NC | NC | NC |
| 4536 | 7593 | TTCCTTCACTCCACTGTGCC | 1 | NC | NC | NC |
| 4537 | 7594 | CTTCCTTCACTCCACTGTGC | 2 | NC | NC | NC |
| 4538 | 7596 | CTCTTCCTTCACTCCACTGT | 1 | NC | NC | NC |
| 4539 | 7597 | GCTCTTCCTTCACTCCACTG | 2 | NC | NC | NC |
| 4540 | 7598 | TGCTCTTCCTTCACTCCACT | 1 | NC | NC | NC |
| 4541 | 7599 | CTGCTCTTCCTTCACTCCAC | 1 | NC | NC | NC |
| 4542 | 7600 | ACTGCTCTTCCTTCACTCCA | 1 | NC | NC | NC |
| 4543 | 7601 | AACTGCTCTTCCTTCACTCC | 2 | NC | NC | NC |
| 4544 | 7602 | AAACTGCTCTTCCTTCACTC | 1 | NC | NC | NC |
| 4545 | 7603 | GAAACTGCTCTTCCTTCACT | 2 | NC | NC | NC |
| 4546 | 7604 | TGAAACTGCTCTTCCTTCAC | 2 | NC | NC | NC |
| 4547 | 7605 | CTGAAACTGCTCTTCCTTCA | 1 | NC | NC | NC |
| 4548 | 7606 | CCTGAAACTGCTCTTCCTTC | 1 | NC | NC | NC |
| 4549 | 7607 | GCCTGAAACTGCTCTTCCTT | 0 | NC | NC | NC |
| 4550 | 7608 | TGCCTGAAACTGCTCTTCCT | 0 | NC | NC | NC |
| 4551 | 7609 | GTGCCTGAAACTGCTCTTCC | 0 | NC | NC | NC |
| 4552 | 7610 | GGTGCCTGAAACTGCTCTTC | 1 | NC | NC | NC |
| 4553 | 7611 | GGGTGCCTGAAACTGCTCTT | 2 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 4554 | 7612 | TGGGTGCCTGAAACTGCTCT | 2 | NC | NC | NC |
| 4555 | 7613 | TTGGGTGCCTGAAACTGCTC | 2 | NC | NC | NC |
| 4556 | 7614 | TTTGGGTGCCTGAAACTGCT | 2 | NC | NC | NC |
| 4557 | 7615 | TTTTGGGTGCCTGAAACTGC | 2 | NC | NC | NC |
| 4558 | 7616 | GTTTTGGGTGCCTGAAACTG | 2 | NC | NC | NC |
| 4559 | 7617 | GGTTTTGGGTGCCTGAAACT | 2 | NC | NC | NC |
| 4560 | 7618 | AGGTTTTGGGTGCCTGAAAC | 2 | NC | NC | NC |
| 4561 | 7643 | AGGTGGAAAACAGGTCGTGG | 2 | NC | NC | NC |
| 4562 | 7644 | CAGGTGGAAAACAGGTCGTG | 2 | NC | NC | NC |
| 4563 | 7645 | TCAGGTGGAAAACAGGTCGT | 2 | NC | NC | NC |
| 4564 | 7646 | TTCAGGTGGAAAACAGGTCG | 2 | NC | NC | NC |
| 4565 | 7647 | CTTCAGGTGGAAAACAGGTC | 2 | NC | NC | NC |
| 4566 | 7648 | TCTTCAGGTGGAAAACAGGT | 2 | NC | NC | NC |
| 4567 | 7649 | CTCTTCAGGTGGAAAACAGG | 2 | NC | NC | NC |
| 4568 | 7650 | GCTCTTCAGGTGGAAAACAG | 2 | NC | NC | NC |
| 4569 | 7651 | GGCTCTTCAGGTGGAAAACA | 2 | NC | NC | NC |
| 4570 | 7652 | TGGCTCTTCAGGTGGAAAAC | 2 | NC | NC | NC |
| 4571 | 7653 | GTGGCTCTTCAGGTGGAAAA | 2 | NC | NC | NC |
| 4572 | 7654 | GGTGGCTCTTCAGGTGGAAA | 2 | NC | NC | NC |
| 4573 | 7658 | AATGGGTGGCTCTTCAGGTG | 2 | NC | NC | NC |
| 4574 | 7659 | GAATGGGTGGCTCTTCAGGT | 2 | NC | NC | NC |
| 4575 | 7661 | TGGAATGGGTGGCTCTTCAG | 2 | NC | NC | NC |
| 4576 | 7662 | ATGGAATGGGTGGCTCTTCA | 2 | NC | NC | NC |
| 4577 | 7663 | GATGGAATGGGTGGCTCTTC | 2 | NC | NC | NC |
| 4578 | 7664 | GGATGGAATGGGTGGCTCTT | 2 | NC | NC | NC |
| 4579 | 7665 | TGGATGGAATGGGTGGCTCT | 2 | NC | NC | NC |
| 4580 | 7666 | TTGGATGGAATGGGTGGCTC | 2 | NC | NC | NC |
| 4581 | 7667 | TTTGGATGGAATGGGTGGCT | 1 | NC | NC | NC |
| 4582 | 7668 | GTTTGGATGGAATGGGTGGC | 1 | NC | NC | NC |
| 4583 | 7669 | GGTTTGGATGGAATGGGTGG | 2 | NC | NC | NC |
| 4584 | 7670 | GGGTTTGGATGGAATGGGTG | 2 | NC | NC | NC |
| 4585 | 7671 | AGGGTTTGGATGGAATGGGT | 2 | NC | NC | NC |
| 4586 | 7672 | AAGGGTTTGGATGGAATGGG | 2 | NC | NC | NC |
| 4587 | 7673 | CAAGGGTTTGGATGGAATGG | 2 | NC | NC | NC |
| 4588 | 7683 | AGACTTTTGCCAAGGGTTTG | 2 | NC | NC | NC |
| 4589 | 7684 | CAGACTTTTGCCAAGGGTTT | 2 | NC | NC | NC |
| 4590 | 7685 | GCAGACTTTTGCCAAGGGTT | 2 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 4591 | 7702 | GCCGGTTCTCTCTGTTAGCA | 2 | NC | NC | NC |
| 4592 | 7704 | TGGCCGGTTCTCTCTGTTAG | 2 | NC | NC | NC |
| 4593 | 7705 | CTGGCCGGTTCTCTCTGTTA | 2 | NC | NC | NC |
| 4594 | 7706 | ACTGGCCGGTTCTCTCTGTT | 1 | NC | NC | NC |
| 4595 | 7707 | TACTGGCCGGTTCTCTCTGT | 2 | NC | NC | NC |
| 4596 | 7708 | ATACTGGCCGGTTCTCTCTG | 1 | NC | NC | NC |
| 4597 | 7709 | CATACTGGCCGGTTCTCTCT | 1 | NC | NC | NC |
| 4598 | 7711 | AGCATACTGGCCGGTTCTCT | 2 | NC | NC | NC |
| 4599 | 7735 | AGACAGGCATGATCGCGACT | 3 | NC | NC | NC |
| 4600 | 7736 | AAGACAGGCATGATCGCGAC | 3 | NC | NC | NC |
| 4601 | 7737 | AAAGACAGGCATGATCGCGA | 2 | NC | NC | NC |
| 4602 | 7738 | TAAAGACAGGCATGATCGCG | 2 | NC | NC | NC |
| 4603 | 7739 | GTAAAGACAGGCATGATCGC | 2 | NC | NC | NC |
| 4604 | 7740 | GGTAAAGACAGGCATGATCG | 2 | NC | NC | NC |
| 4605 | 7741 | GGGTAAAGACAGGCATGATC | 2 | NC | NC | NC |
| 4606 | 7742 | AGGGTAAAGACAGGCATGAT | 2 | NC | NC | NC |
| 4607 | 7743 | GAGGGTAAAGACAGGCATGA | 1 | NC | NC | NC |
| 4608 | 7744 | AGAGGGTAAAGACAGGCATG | 1 | NC | NC | NC |
| 4609 | 7745 | TAGAGGGTAAAGACAGGCAT | 1 | NC | NC | NC |
| 4610 | 7746 | TTAGAGGGTAAAGACAGGCA | 1 | NC | NC | NC |
| 4611 | 7747 | CTTAGAGGGTAAAGACAGGC | 2 | NC | NC | NC |
| 4612 | 7748 | GCTTAGAGGGTAAAGACAGG | 2 | NC | NC | NC |
| 4613 | 7749 | AGCTTAGAGGGTAAAGACAG | 2 | NC | NC | NC |
| 4614 | 7750 | CAGCTTAGAGGGTAAAGACA | 2 | NC | NC | NC |
| 4615 | 7751 | TCAGCTTAGAGGGTAAAGAC | 2 | NC | NC | NC |
| 4616 | 7752 | TTCAGCTTAGAGGGTAAAGA | 2 | NC | NC | NC |
| 4617 | 7753 | CTTCAGCTTAGAGGGTAAAG | 1 | NC | NC | NC |
| 4618 | 7767 | CCGTTGATGAGCAGCTTCAG | 2 | NC | NC | NC |
| 4619 | 7768 | ACCGTTGATGAGCAGCTTCA | 2 | NC | NC | NC |
| 4620 | 7769 | CACCGTTGATGAGCAGCTTC | 2 | NC | NC | NC |
| 4621 | 7770 | TCACCGTTGATGAGCAGCTT | 2 | NC | NC | NC |
| 4622 | 7771 | CTCACCGTTGATGAGCAGCT | 2 | NC | NC | NC |
| 4623 | 7779 | TTTGCCATCTCACCGTTGAT | 2 | NC | NC | NC |
| 4624 | 7780 | TTTTGCCATCTCACCGTTGA | 3 | NC | NC | NC |
| 4625 | 7781 | TTTTTGCCATCTCACCGTTG | 3 | NC | NC | NC |
| 4626 | 7782 | CTTTTTGCCATCTCACCGTT | 2 | NC | NC | NC |
| 4627 | 7783 | CCTTTTTGCCATCTCACCGT | 2 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 4628 | 7784 | ACCTTTTTGCCATCTCACCG | 2 | NC | NC | NC |
| 4629 | 7785 | CACCTTTTTGCCATCTCACC | 1 | NC | NC | NC |
| 4630 | 7786 | CCACCTTTTTGCCATCTCAC | 2 | NC | NC | NC |
| 4631 | 7787 | CCCACCTTTTTGCCATCTCA | 2 | NC | NC | NC |
| 4632 | 7788 | ACCCACCTTTTTGCCATCTC | 2 | NC | NC | NC |
| 4633 | 7789 | GACCCACCTTTTTGCCATCT | 2 | NC | NC | NC |
| 4634 | 7790 | GGACCCACCTTTTTGCCATC | 3 | NC | NC | NC |
| 4635 | 7803 | TTTCCCCTCTTCTGGACCCA | 1 | NC | NC | NC |
| 4636 | 7804 | TTTTCCCCTCTTCTGGACCC | 1 | NC | NC | NC |
| 4637 | 7805 | CTTTTCCCCTCTTCTGGACC | 1 | NC | NC | NC |
| 4638 | 7806 | TCTTTTCCCCTCTTCTGGAC | 1 | NC | NC | NC |
| 4639 | 7807 | TTCTTTTCCCCTCTTCTGGA | 1 | NC | NC | NC |
| 4640 | 7808 | CTTCTTTTCCCCTCTTCTGG | 1 | NC | NC | NC |
| 4641 | 7809 | CCTTCTTTTCCCCTCTTCTG | 1 | NC | NC | NC |
| 4642 | 7810 | CCCTTCTTTTCCCCTCTTCT | 1 | NC | NC | NC |
| 4643 | 7811 | TCCCTTCTTTTCCCCTCTTC | 1 | NC | NC | NC |
| 4644 | 7812 | CTCCCTTCTTTTCCCCTCTT | 1 | NC | NC | NC |
| 4645 | 7813 | ACTCCCTTCTTTTCCCCTCT | 1 | NC | NC | NC |
| 4646 | 7814 | GACTCCCTTCTTTTCCCCTC | 1 | NC | NC | NC |
| 4647 | 7815 | AGACTCCCTTCTTTTCCCCT | 1 | NC | NC | NC |
| 4648 | 7816 | CAGACTCCCTTCTTTTCCCC | 1 | NC | NC | NC |
| 4649 | 7817 | ACAGACTCCCTTCTTTTCCC | 2 | NC | NC | NC |
| 4650 | 7818 | CACAGACTCCCTTCTTTTCC | 2 | NC | NC | NC |
| 4651 | 7819 | TCACAGACTCCCTTCTTTTC | 2 | NC | NC | NC |
| 4652 | 7820 | TTCACAGACTCCCTTCTTTT | 2 | NC | NC | NC |
| 4653 | 7821 | TTTCACAGACTCCCTTCTTT | 2 | NC | NC | NC |
| 4654 | 7822 | TTTTCACAGACTCCCTTCTT | 2 | NC | NC | NC |
| 4655 | 7823 | GTTTTCACAGACTCCCTTCT | 2 | NC | NC | NC |
| 4656 | 7824 | TGTTTTCACAGACTCCCTTC | 2 | NC | NC | NC |
| 4657 | 7825 | TTGTTTTCACAGACTCCCTT | 1 | NC | NC | NC |
| 4658 | 7826 | TTTGTTTTCACAGACTCCCT | 2 | NC | NC | NC |
| 4659 | 7827 | TTTTGTTTTCACAGACTCCC | 1 | NC | NC | NC |
| 4660 | 7828 | ATTTTGTTTTCACAGACTCC | 1 | NC | NC | NC |
| 4661 | 7829 | CATTTTGTTTTCACAGACTC | 1 | NC | NC | NC |
| 4662 | 7830 | GCATTTTGTTTTCACAGACT | 2 | NC | NC | NC |
| 4663 | 7831 | AGCATTTTGTTTTCACAGAC | 2 | NC | NC | NC |
| 4664 | 7832 | CAGCATTTTGTTTTCACAGA | 2 | NC | NC | NC |

TABLE 2-continued

Exemplary Oligonucleotides

| SEQ ID NO | Position | Sequence | Off-target Score Human | Cyno | Mouse | Rat |
|---|---|---|---|---|---|---|
| 4665 | 7833 | TCAGCATTTTGTTTTCACAG | 2 | NC | NC | NC |
| 4666 | 7834 | TTCAGCATTTTGTTTTCACA | 1 | NC | NC | NC |
| 4667 | 7835 | CTTCAGCATTTTGTTTTCAC | 1 | NC | NC | NC |
| 4668 | 7836 | TCTTCAGCATTTTGTTTTCA | 1 | NC | NC | NC |
| 4669 | 7837 | TTCTTCAGCATTTTGTTTTC | 1 | NC | NC | NC |
| 4670 | 7838 | ATTCTTCAGCATTTTGTTTT | 1 | NC | NC | NC |
| 4671 | 7839 | GATTCTTCAGCATTTTGTTT | 1 | NC | NC | NC |
| 4672 | 7840 | AGATTCTTCAGCATTTTGTT | 1 | NC | NC | NC |
| 4673 | 7841 | CAGATTCTTCAGCATTTTGT | 1 | NC | NC | NC |
| 4674 | 7842 | GCAGATTCTTCAGCATTTTG | 2 | NC | NC | NC |
| 4675 | 7843 | TGCAGATTCTTCAGCATTTT | 1 | NC | NC | NC |
| 4676 | 7848 | TTTGATGCAGATTCTTCAGC | 2 | NC | NC | NC |
| 4677 | 7849 | ATTTGATGCAGATTCTTCAG | 2 | NC | NC | NC |
| 4678 | 7850 | TATTTGATGCAGATTCTTCA | 1 | NC | NC | NC |
| 4679 | 7851 | TTATTTGATGCAGATTCTTC | 1 | NC | NC | NC |
| 4680 | 7852 | TTTATTTGATGCAGATTCTT | 1 | NC | NC | NC |
| 4681 | 7853 | GTTTATTTGATGCAGATTCT | 2 | NC | NC | NC |
| 4682 | 7854 | GGTTTATTTGATGCAGATTC | 2 | NC | NC | NC |
| 4683 | 7855 | GGGTTTATTTGATGCAGATT | 2 | NC | NC | NC |
| 4684 | 7856 | AGGGTTTATTTGATGCAGAT | 2 | NC | NC | NC |
| 4685 | 7857 | AAGGGTTTATTTGATGCAGA | 1 | NC | NC | NC |
| 4686 | 7858 | GAAGGGTTTATTTGATGCAG | 2 | NC | NC | NC |
| 4687 | 7859 | GGAAGGGTTTATTTGATGCA | 2 | NC | NC | NC |
| 4688 | 7860 | AGGAAGGGTTTATTTGATGC | 2 | NC | NC | NC |
| 4689 | 7861 | AAGGAAGGGTTTATTTGATG | 2 | NC | NC | NC |
| 4690 | 7862 | GAAGGAAGGGTTTATTTGAT | 2 | NC | NC | NC |
| 4691 | 7863 | GGAAGGAAGGGTTTATTTGA | 2 | NC | NC | NC |
| 4692 | 7864 | AGGAAGGAAGGGTTTATTTG | 2 | NC | NC | NC |
| 4693 | 7865 | AAGGAAGGAAGGGTTTATTT | 1 | NC | NC | NC |
| 4694 | 7866 | GAAGGAAGGAAGGGTTTATT | 1 | NC | NC | NC |
| 4695 | 7867 | GGAAGGAAGGAAGGGTTTAT | 1 | NC | NC | NC |
| 4696 | 7868 | AGGAAGGAAGGAAGGGTTTA | 0 | NC | NC | NC |
| 4697 | 7869 | AAGGAAGGAAGGAAGGGTTT | 0 | NC | NC | NC |
| 4698 | 7870 | AAAGGAAGGAAGGAAGGGTT | 1 | NC | NC | NC |
| 4699 | 7871 | AAAAGGAAGGAAGGAAGGGT | 0 | NC | NC | NC |
| 4700 | 7872 | AAAAAGGAAGGAAGGAAGGG | 0 | NC | NC | NC |
| 4701 | 7873 | GAAAAAGGAAGGAAGGAAGG | 0 | NC | NC | NC |

TABLE 2-continued

| Exemplary Oligonucleotides | | | | | | |
|---|---|---|---|---|---|---|
| SEQ | | | Off-target Score | | | |
| ID NO | Position | Sequence | Human | Cyno | Mouse | Rat |
| 4702 | 7874 | GGAAAAAGGAAGGAAGGAAG | 0 | NC | NC | NC |
| 4703 | 7875 | AGGAAAAAGGAAGGAAGGAA | 0 | NC | NC | NC |
| 4704 | 7876 | AAGGAAAAAGGAAGGAAGGA | 0 | NC | NC | NC |
| 4705 | 7877 | GAAGGAAAAAGGAAGGAAGG | 0 | NC | NC | NC |
| 4706 | 7878 | TGAAGGAAAAAGGAAGGAAG | 1 | NC | NC | NC |
| 4707 | 7879 | TTGAAGGAAAAAGGAAGGAA | 1 | NC | NC | NC |
| 4708 | 7880 | TTTGAAGGAAAAAGGAAGGA | 1 | NC | NC | NC |
| 4709 | 7881 | TTTTGAAGGAAAAAGGAAGG | 1 | NC | NC | NC |
| 4710 | 7882 | TTTTTGAAGGAAAAAGGAAG | 1 | NC | NC | NC |

Example 2. Antisense Inhibition of MLH3

Inhibition or knockdown of MLH3 can be demonstrated using a cell-based assay. For example. HEK293. NIH3T3, or Hela or another available mammalian cell line with oligonucleotides targeting MLH3 identified above in Example 1 using at least five different dose levels, using transfection reagents such as LIPOFECTAMINE™ 2000 (Invitrogen) following the manufacturer's instructions. Cells are harvested at multiple time points up to 7 days post transfection for either mRNA or protein analyses. Knockdown of mRNA and protein are determined by RT-gPCR or western blot analyses respectively, using standard molecular biology techniques as previously described (see, for example, as described in Drouet et al., 2014, PLOS One 9(6): e99341). The relative levels of the MLH3 mRNA and protein at the different oligonucleotide levels are compared with a mock oligonucleotide control. The most potent oligonucleotides (for example, those which are capable of at least 90%, at least 95%, at least 97%, at least 98%, or at least 99% or more, reduction in protein levels when compared with controls) are selected for subsequent studies, for example, as described in the examples below.

Human cell lines

HeLa cells were obtained from ATCC (ATCC in partnership with LGC Standards, Wesel, Germany, cat. #ATCC-CRM-CCL-2) and cultured in HAM's F12 (#FG0815, Biochrom, Berlin, Germany), supplemented to contain 10% fetal calf serum (1248D, Biochrom GmbH, Berlin, Germany), and 100 U/ml Penicillin/100 μg/ml Streptomycin (A2213, Biochrom GmbH, Berlin, Germany) at 37° C. in an atmosphere with 5% $CO_2$ in a humidified incubator. For transfection of HeLa cells with ASOs, cells were seeded at a density of 15,000 cells/well into 96-well tissue culture plates (#655180, GBO, Germany).

Transfections

In HeLa cells, transfection of ASOs was carried out with LIPOFECTAMINE™ 2000 (Invitrogen/Life Technologies, Karlsruhe, Germany) according to manufacturer's instructions for reverse transfection with 0.25 μL LIPOFECTAMINE$^{T}$" 2000 per well.

The dual dose screen was performed with ASOs in quadruplicates at 20 nM and 2 nM respectively, with two ASOs targeting AHSA1 (one MOE-ASO and one 2'oMe-ASO) as unspecific controls and a mock transfection Dose-response experiments were done with ASOs in 5 concentrations transfected in quadruplicates, starting at 20 nM in 5-6-fold dilutions steps down to ~15-32 pM. Mock transfected cells served as control in dose-response curve (DRC) experiments.

Analysis and Quantitation

After 24 h of incubation with ASOs, medium was removed and cells were lysed in 150 μl Medium-Lysis Mixture (1 volume lysis mixture, 2 volumes cell culture medium) and then incubated at 53° C. for 30 minutes, bDNA assay was performed according to manufacturer's instructions. Luminescence was read using 1420 Luminescence Counter (WALLAC VICTOR Light, Perkin Elmer, Rodgau-Jügesheim, Germany) following 30 minutes incubation at RT in the dark.

The two Ahsa1-ASOs (one 2'-OMe and one MOE-modified) served at the same time as unspecific controls for respective target mRNA expression and as a positive control to analyze transfection efficiency with regards to Ahsa1 mRNA level. By hybridization with an Ahsa1 probeset, the mock transfected wells served as controls for Ahsa1 mRNA level. Transfection efficiency for each 96-well plate and both doses in the dual dose screen were calculated by relating Ahsa1-level with Ahsa1-ASO (normalized to GapDH) to Ahsa1-level obtained with mock controls.

For each well, the target mRNA level was normalized to the respective GAPDH mRNA level. The activity of a given ASO was expressed as percent mRNA concentration of the respective target (normalized to GAPDH mRNA) in treated cells, relative to the target mRNA concentration (normalized to GAPDH mRNA) averaged across control wells.

The results of the dual-dose screen of ~480 ASOs targeting MLH3, as well as $IC_{20}$, $IC_{50}$ and $IC_{80}$ values of approximately 48 positive ASOs from the dual dose screen, are shown in Table 3.

TABLE 3

| Positive ASOs | | | | | | | | | | | | | |
|---|---|---|---|---|---|---|---|---|---|---|---|---|---|
| SEQ ID NO | Position | Sequence | Off-target Score | | | | mean % mRNA remaining | | SD % mRNA remaining | | IC20 (nM) | IC50 (nM) | IC80 (nM) |
| | | | Human | Cyno | Mouse | Rat | 2 nM | 20 nM | 2 nM | 20 nM | | | |
| 89 | 224 | TACTTCAACTGACAAGCACT | 2 | 2 | NC | NC | 74.75 | 16.41 | 5.11 | 1.90 | NA | NA | NA |
| 90 | 225 | GTACTTCAACTGACAAGCAC | 2 | 2 | NC | NC | 77.73 | 52.54 | 2.17 | 2.02 | NA | NA | NA |
| 92 | 227 | TTGTACTTCAACTGACAAGC | 2 | 2 | NC | NC | 75.57 | 30.32 | 5.23 | 1.51 | NA | NA | NA |
| 101 | 237 | GCAATTTGGCTTGTACTTCA | 2 | 2 | NC | NC | 77.37 | 64.88 | 5.04 | 9.95 | NA | NA | NA |
| 102 | 238 | CGCAATTTGGCTTGTACTTC | 2 | 3 | NC | NC | 71.59 | 15.63 | 3.42 | 1.01 | NA | NA | NA |
| 103 | 239 | ACGCAATTTGGCTTGTACTT | 2 | 3 | NC | NC | 72.11 | 60.32 | 3.42 | 7.53 | NA | NA | NA |
| 106 | 242 | AGAACGCAATTTGGCTTGTA | 2 | 2 | NC | NC | 71.44 | 71.53 | 4.33 | 37.95 | NA | NA | NA |
| 107 | 243 | CAGAACGCAATTTGGCTTGT | 3 | 2 | NC | NC | 66.80 | 36.49 | 5.84 | 5.28 | NA | NA | NA |
| 108 | 244 | CCAGAACGCAATTTGGCTTG | 3 | 3 | NC | NC | 62.90 | 37.68 | 3.87 | 4.83 | NA | NA | NA |
| 109 | 245 | ACCAGAACGCAATTTGGCTT | 3 | 2 | NC | NC | 66.82 | 98.40 | 2.36 | 16.21 | NA | NA | NA |
| 110 | 246 | AACCAGAACGCAATTTGGCT | 2 | 2 | NC | NC | 60.40 | 44.74 | 15.63 | 2.25 | NA | NA | NA |
| 111 | 247 | AAACCAGAACGCAATTTGGC | 2 | 2 | NC | NC | 70.74 | 28.71 | 1.63 | 2.76 | NA | NA | NA |
| 115 | 270 | ATTGGCCCAAGGAGCTTATG | 2 | 2 | NC | NC | 78.95 | 45.99 | 2.10 | 2.57 | NA | NA | NA |
| 116 | 271 | CATTGGCCCAAGGAGCTTAT | 2 | 3 | NC | NC | 76.12 | 28.26 | 10.83 | 1.81 | NA | NA | NA |
| 117 | 272 | ACATTGGCCCAAGGAGCTTA | 2 | 3 | NC | NC | 75.06 | 53.28 | 2.48 | 2.00 | NA | NA | NA |
| 133 | 288 | GGGCAAGTTCCTCAACACAT | 2 | 2 | NC | NC | 69.85 | 94.09 | 0.43 | 11.41 | NA | NA | NA |
| 134 | 289 | AGGGCAAGTTCCTCAACACA | 2 | 2 | NC | NC | 74.03 | 69.07 | 3.53 | 5.32 | NA | NA | NA |
| 135 | 296 | ACTGTTGAGGGCAAGTTCCT | 2 | 2 | NC | NC | 79.51 | 65.67 | 4.25 | 5.62 | NA | NA | NA |
| 150 | 324 | CAGCCACACATTTTGCTTCA | 2 | 2 | NC | NC | 66.83 | 25.32 | 2.76 | 2.23 | NA | NA | NA |
| 151 | 325 | ACAGCCACACATTTTGCTTC | 2 | 2 | NC | NC | 69.96 | 72.78 | 4.30 | 4.32 | NA | NA | NA |
| 152 | 326 | GACAGCCACACATTTTGCTT | 2 | 2 | NC | NC | 80.79 | 113.47 | 16.94 | 5.71 | NA | NA | NA |
| 154 | 328 | CTGACAGCCACACATTTTGC | 2 | 2 | NC | NC | 79.02 | 26.85 | 2.20 | 3.00 | NA | NA | NA |
| 160 | 334 | TTCACCCTGACAGCCACACA | 2 | 1 | NC | NC | 92.28 | 10.93 | 2.00 | 2.21 | NA | NA | NA |
| 161 | 335 | ATTCACCCTGACAGCCACAC | 2 | 2 | NC | NC | 83.55 | 10.33 | 5.21 | 1.56 | NA | NA | NA |
| 163 | 337 | ATATTCACCCTGACAGCCAC | 2 | 2 | NC | NC | 87.05 | 9.72 | 2.44 | 0.70 | NA | NA | NA |
| 164 | 338 | CATATTCACCCTGACAGCCA | 2 | 2 | NC | NC | 81.52 | 8.96 | 1.50 | 1.61 | 0.31 | 1.06 | 4.15 |
| 166 | 340 | TCCATATTCACCCTGACAGC | 2 | 2 | NC | NC | 87.79 | 9.93 | 13.96 | 0.77 | NA | NA | NA |
| 168 | 342 | TTTCCATATTCACCCTGACA | 2 | 2 | NC | NC | 77.41 | 15.50 | 4.02 | 2.31 | NA | NA | NA |
| 170 | 344 | GGTTTCCATATTCACCCTGA | 2 | 2 | NC | NC | 65.76 | 79.24 | 1.84 | 6.95 | NA | NA | NA |
| 174 | 358 | ACTTGAACTTGGAAGGTTTC | 2 | 2 | 2 | 2 | 82.04 | 114.15 | 4.85 | 4.63 | NA | NA | NA |
| 175 | 359 | CACTTGAACTTGGAAGGTTT | 2 | 2 | 2 | 1 | 83.32 | 25.76 | 16.25 | 2.93 | NA | NA | NA |
| 176 | 360 | TCACTTGAACTTGGAAGGTT | 1 | 1 | 1 | 2 | 75.49 | 22.95 | 3.67 | 3.55 | NA | NA | NA |
| 178 | 362 | TATCACTTGAACTTGGAAGG | 1 | 1 | 2 | 3 | 95.08 | 17.86 | 19.33 | 1.20 | NA | NA | NA |
| 180 | 364 | TCTATCACTTGAACTTGGAA | 2 | 1 | 1 | 2 | 79.06 | 19.79 | 4.78 | 1.89 | NA | NA | NA |
| 181 | 365 | GTCTATCACTTGAACTTGGA | 2 | 1 | 1 | 2 | 77.01 | 50.90 | 0.99 | 4.78 | NA | NA | NA |
| 182 | 366 | TGTCTATCACTTGAACTTGG | 2 | 2 | 1 | 1 | 75.65 | 39.52 | 1.01 | 6.03 | NA | NA | NA |

TABLE 3-continued

Positive ASOs

| SEQ ID NO | Position | Sequence | Off-target Score Human | Off-target Score Cyno | Off-target Score Mouse | Off-target Score Rat | mean % mRNA remaining 2 nM | mean % mRNA remaining 20 nM | SD % mRNA remaining 2 nM | SD % mRNA remaining 20 nM | IC20 (nM) | IC50 (nM) | IC80 (nM) |
|---|---|---|---|---|---|---|---|---|---|---|---|---|---|
| 183 | 367 | TTGTCTATCACTTGAACTTG | 2 | 2 | 2 | 2 | 88.34 | 20.10 | 5.86 | 3.29 | NA | NA | NA |
| 184 | 368 | ATTGTCTATCACTTGAACTT | 2 | 2 | 2 | NC | 84.20 | 54.98 | 1.73 | 3.67 | NA | NA | NA |
| 185 | 369 | CATTGTCTATCACTTGAACT | 2 | 2 | 2 | NC | 95.44 | 25.25 | 17.34 | 2.84 | NA | NA | NA |
| 186 | 370 | CCATTGTCTATCACTTGAAC | 2 | 2 | 2 | NC | 75.20 | 15.87 | 2.35 | 0.58 | 0.25 | 0.92 | 4.36 |
| 187 | 371 | TCCATTGTCTATCACTTGAA | 2 | 2 | 2 | NC | 70.21 | 17.69 | 1.89 | 1.61 | 0.36 | 1.21 | 8.86 |
| 188 | 372 | ATCCATTGTCTATCACTTGA | 2 | 2 | NC | NC | 73.77 | 22.51 | 1.88 | 5.13 | NA | NA | NA |
| 189 | 373 | AATCCATTGTCTATCACTTG | 2 | 2 | NC | NC | 77.83 | 26.73 | 3.24 | 1.26 | NA | NA | NA |
| 201 | 386 | ACTCCCCATCCCAAATCCAT | 2 | 2 | NC | NC | 80.75 | 22.43 | 3.52 | 1.83 | NA | NA | NA |
| 211 | 396 | CTACATCATCACTCCCCATC | 2 | 2 | NC | NC | 77.20 | 12.74 | 2.53 | 1.37 | NA | NA | NA |
| 212 | 397 | TCTACATCATCACTCCCCAT | 2 | 2 | NC | NC | 74.42 | 12.19 | 2.00 | 0.49 | 3.10 | 11.27 | ND |
| 229 | 414 | AACGATTTCCCACTTTCTCT | 2 | 2 | NC | NC | 72.64 | 22.78 | 3.19 | 1.16 | NA | NA | NA |
| 230 | 415 | TAACGATTTCCCACTTTCTC | 2 | 2 | NC | NC | 79.03 | 11.66 | 5.33 | 1.49 | NA | NA | NA |
| 231 | 416 | ATAACGATTTCCCACTTTCT | 2 | 2 | NC | NC | 78.95 | 14.41 | 4.83 | 4.50 | NA | NA | NA |
| 234 | 426 | TACTGGTGAAATAACGATTT | 2 | 3 | NC | NC | 80.89 | 30.57 | 2.84 | 0.46 | NA | NA | NA |
| 235 | 427 | TTACTGGTGAAATAACGATT | 2 | 2 | NC | NC | 65.31 | 19.49 | 5.20 | 0.84 | 0.48 | 1.36 | 4.89 |
| 236 | 428 | TTTACTGGTGAAATAACGAT | 2 | 2 | NC | NC | 87.08 | 21.12 | 7.01 | 2.19 | NA | NA | NA |
| 237 | 429 | ATTTACTGGTGAAATAACGA | 2 | 2 | NC | NC | 85.92 | 41.52 | 3.99 | 1.99 | NA | NA | NA |
| 238 | 430 | CATTTACTGGTGAAATAACG | 2 | 2 | NC | NC | 90.43 | 20.60 | 14.34 | 1.10 | NA | NA | NA |
| 241 | 433 | TGGCATTTACTGGTGAAATA | 2 | 2 | NC | NC | 75.60 | 27.06 | 6.23 | 2.19 | NA | NA | NA |
| 242 | 434 | GTGGCATTTACTGGTGAAAT | 2 | 1 | NC | NC | 74.62 | 65.91 | 5.68 | 4.88 | NA | NA | NA |
| 248 | 452 | CTCCAAGTCCTGTACCGAGT | 3 | 3 | NC | NC | 66.48 | 35.79 | 2.84 | 6.63 | NA | NA | NA |
| 249 | 453 | TCTCCAAGTCCTGTACCGAG | 3 | 3 | NC | NC | 69.72 | 35.31 | 5.64 | 2.28 | NA | NA | NA |
| 250 | 454 | TTCTCCAAGTCCTGTACCGA | 2 | 3 | NC | NC | 80.09 | 15.49 | 5.44 | 1.27 | NA | NA | NA |
| 254 | 468 | CATAAAACCTTGGATTCTCC | 2 | 1 | NC | NC | 72.14 | 15.86 | 27.20 | 0.86 | NA | NA | NA |
| 265 | 480 | CTCCTCGGAAACCATAAAAC | 2 | 2 | NC | NC | 81.92 | 20.89 | 5.26 | 2.21 | NA | NA | NA |
| 266 | 481 | TCTCCTCGGAAACCATAAAA | 2 | 2 | NC | NC | 84.83 | 18.78 | 3.51 | 2.57 | NA | NA | NA |
| 267 | 482 | CTCTCCTCGGAAACCATAAA | 2 | 2 | NC | NC | 86.89 | 12.64 | 2.43 | 1.22 | NA | NA | NA |
| 268 | 483 | CCTCTCCTCGGAAACCATAA | 2 | 2 | NC | NC | 81.76 | 11.71 | 7.00 | 1.87 | NA | NA | NA |
| 269 | 484 | GCCTCTCCTCGGAAACCATA | 2 | 1 | NC | NC | 80.11 | 25.50 | 4.59 | 1.33 | NA | NA | NA |
| 282 | 537 | TTTTCTTGGACGAAATTTCC | 2 | 2 | NC | NC | 86.51 | 14.81 | 2.17 | 2.33 | NA | NA | NA |
| 283 | 538 | TTTTTCTTGGACGAAATTTC | 2 | 1 | NC | NC | 92.35 | 17.43 | 9.00 | 1.47 | NA | NA | NA |
| 284 | 539 | GTTTTTCTTGGACGAAATTT | 2 | 2 | NC | NC | 85.97 | 63.49 | 5.37 | 2.09 | NA | NA | NA |
| 285 | 540 | TGTTTTTCTTGGACGAAATT | 2 | 2 | NC | NC | 91.72 | 30.14 | 6.86 | 5.01 | NA | NA | NA |
| 286 | 541 | CTGTTTTTCTTGGACGAAAT | 2 | 2 | NC | NC | 78.31 | 16.19 | 11.18 | 2.23 | NA | NA | NA |
| 287 | 542 | CCTGTTTTTCTTGGACGAAA | 3 | 1 | NC | NC | 72.73 | 19.56 | 4.99 | 2.01 | NA | NA | NA |
| 288 | 543 | TCCTGTTTTTCTTGGACGAA | 2 | 2 | NC | NC | 78.70 | 23.15 | 4.59 | 1.40 | NA | NA | NA |

TABLE 3-continued

| Positive ASOs | | | | | | | | | | | | | |
|---|---|---|---|---|---|---|---|---|---|---|---|---|---|
| SEQ ID NO | Position | Sequence | Off-target Score | | | | mean % mRNA remaining | | SD % mRNA remaining | | IC20 (nM) | IC50 (nM) | IC80 (nM) |
| | | | Human | Cyno | Mouse | Rat | 2 nM | 20 nM | 2 nM | 20 nM | | | |
| 294 | 552 | TTTTCATTGTCCTGTTTTTC | 2 | 1 | NC | NC | 88.62 | 13.49 | 2.05 | 3.75 | NA | NA | NA |
| 296 | 554 | AGTTTTCATTGTCCTGTTTT | 2 | 1 | NC | NC | 85.86 | 26.44 | 6.19 | 2.68 | NA | NA | NA |
| 309 | 567 | ACAGTTTCACAAAAGTTTTC | 2 | 2 | NC | NC | 89.08 | 82.86 | 5.13 | 4.37 | NA | NA | NA |
| 316 | 584 | GGCTTTTCCACTCTGAAACA | 2 | 1 | NC | NC | 79.87 | 105.73 | 3.27 | 5.14 | NA | NA | NA |
| 317 | 585 | GGGCTTTTCCACTCTGAAAC | 2 | 2 | NC | NC | 75.58 | 156.14 | 5.08 | 9.80 | NA | NA | NA |
| 318 | 586 | AGGGCTTTTCCACTCTGAAA | 2 | 2 | NC | NC | 66.99 | 95.25 | 5.64 | 11.62 | NA | NA | NA |
| 319 | 587 | CAGGGCTTTTCCACTCTGAA | 2 | 2 | NC | NC | 64.01 | 27.51 | 4.07 | 0.76 | NA | NA | NA |
| 320 | 588 | TCAGGGCTTTTCCACTCTGA | 2 | 2 | NC | NC | 61.84 | 36.06 | 14.35 | 2.59 | NA | NA | NA |
| 321 | 589 | TTCAGGGCTTTTCCACTCTG | 2 | 2 | NC | NC | 56.27 | 43.83 | 9.73 | 4.59 | NA | NA | NA |
| 322 | 590 | TTTCAGGGCTTTTCCACTCT | 2 | 1 | NC | NC | 69.47 | 12.11 | 2.21 | 2.43 | 0.23 | 0.99 | 4.72 |
| 328 | 613 | CTAGTCACATCAGCTTCACA | 3 | 3 | NC | NC | 74.37 | 15.78 | 6.09 | 6.37 | NA | NA | NA |
| 329 | 614 | TCTAGTCACATCAGCTTCAC | 2 | 2 | NC | NC | 64.74 | 30.36 | 2.06 | 3.30 | NA | NA | NA |
| 366 | 684 | CCATGCATTTCCTCCTTACA | 2 | 2 | NC | NC | 82.11 | 9.26 | 14.94 | 1.38 | NA | NA | NA |
| 367 | 685 | TCCATGCATTTCCTCCTTAC | 2 | 2 | NC | NC | 67.01 | 8.69 | 3.44 | 1.52 | 0.21 | 0.73 | 3.24 |
| 368 | 686 | GTCCATGCATTTCCTCCTTA | 2 | 2 | NC | NC | 72.03 | 17.51 | 4.65 | 2.55 | 0.13 | 0.42 | 3.75 |
| 370 | 688 | GGGTCCATGCATTTCCTCCT | 2 | 2 | NC | NC | 55.45 | 95.20 | 4.57 | 3.51 | NA | NA | NA |
| 376 | 694 | AGTCTAGGGTCCATGCATTT | 2 | 2 | NC | NC | 68.73 | 71.63 | 4.31 | 5.94 | NA | NA | NA |
| 377 | 695 | CAGTCTAGGGTCCATGCATT | 2 | 3 | NC | NC | 65.93 | 29.22 | 2.48 | 1.68 | NA | NA | NA |
| 378 | 696 | CCAGTCTAGGGTCCATGCAT | 2 | 2 | NC | NC | 68.89 | 43.82 | 12.06 | 2.01 | NA | NA | NA |
| 379 | 697 | TCCAGTCTAGGGTCCATGCA | 2 | 2 | NC | NC | 69.40 | 17.13 | 6.12 | 4.20 | 0.04 | 0.14 | 0.69 |
| 381 | 700 | AACTCCAGTCTAGGGTCCAT | 2 | 2 | NC | NC | 70.96 | 25.76 | 2.51 | 2.83 | NA | NA | NA |
| 382 | 701 | AAACTCCAGTCTAGGGTCCA | 2 | 2 | NC | NC | 65.58 | 25.73 | 2.58 | 2.89 | NA | NA | NA |
| 383 | 702 | CAAACTCCAGTCTAGGGTCC | 2 | 2 | NC | NC | 67.74 | 20.58 | 1.66 | 3.61 | NA | NA | NA |
| 384 | 703 | TCAAACTCCAGTCTAGGGTC | 2 | 2 | NC | NC | 68.97 | 17.75 | 1.89 | 5.81 | 0.04 | 0.16 | 0.89 |
| 385 | 704 | CTCAAACTCCAGTCTAGGGT | 2 | 2 | NC | NC | 64.06 | 17.11 | 0.68 | 4.06 | 0.01 | 0.06 | 0.44 |
| 386 | 705 | TCTCAAACTCCAGTCTAGGG | 2 | 2 | NC | NC | 59.61 | 27.43 | 2.42 | 1.28 | NA | NA | NA |
| 387 | 706 | TTCTCAAACTCCAGTCTAGG | 2 | 2 | NC | NC | 69.04 | 20.37 | 4.66 | 1.93 | NA | NA | NA |
| 388 | 707 | CTTCTCAAACTCCAGTCTAG | 2 | 2 | NC | NC | 62.05 | 16.91 | 6.78 | 1.92 | 0.39 | 1.16 | 8.90 |
| 389 | 708 | CCTTCTCAAACTCCAGTCTA | 2 | 2 | NC | NC | 71.55 | 15.14 | 2.65 | 3.37 | 0.34 | 1.31 | 6.20 |
| 390 | 709 | ACCTTCTCAAACTCCAGTCT | 2 | 2 | NC | NC | 71.92 | 25.78 | 4.24 | 1.45 | NA | NA | NA |
| 391 | 710 | AACCTTCTCAAACTCCAGTC | 2 | 2 | NC | NC | 71.82 | 13.89 | 1.28 | 2.30 | 0.07 | 0.31 | 3.27 |
| 392 | 711 | TAACCTTCTCAAACTCCAGT | 2 | 1 | NC | NC | 74.03 | 11.74 | 5.34 | 1.85 | 0.15 | 0.84 | 5.10 |
| 393 | 712 | CTAACCTTCTCAAACTCCAG | 2 | 2 | NC | NC | 79.92 | 11.57 | 3.50 | 1.51 | NA | NA | NA |
| 394 | 713 | CCTAACCTTCTCAAACTCCA | 2 | 1 | NC | NC | 79.57 | 11.43 | 4.85 | 2.23 | NA | NA | NA |
| 395 | 714 | GCCTAACCTTCTCAAACTCC | 2 | 2 | NC | NC | 64.28 | 20.03 | 15.77 | 3.63 | 0.12 | 0.45 | 3.27 |
| 396 | 715 | TGCCTAACCTTCTCAAACTC | 2 | 2 | NC | NC | 96.06 | 22.74 | 15.84 | 1.57 | NA | NA | NA |

TABLE 3-continued

Positive ASOs

| SEQ ID NO | Position | Sequence | Off-target Score Human | Off-target Score Cyno | Off-target Score Mouse | Off-target Score Rat | mean % mRNA remaining 2 nM | mean % mRNA remaining 20 nM | SD % mRNA remaining 2 nM | SD % mRNA remaining 20 nM | IC20 (nM) | IC50 (nM) | IC80 (nM) |
|---|---|---|---|---|---|---|---|---|---|---|---|---|---|
| 397 | 716 | CTGCCTAACC TTCTCAAACT | 2 | 1 | NC | NC | 85.17 | 21.36 | 4.27 | 3.49 | NA | NA | NA |
| 398 | 717 | TCTGCCTAAC CTTCTCAAAC | 2 | 1 | NC | NC | 88.59 | 27.39 | 1.59 | 4.98 | NA | NA | NA |
| 399 | 718 | CTCTGCCTAA CCTTCTCAAA | 2 | 2 | NC | NC | 78.68 | 14.58 | 9.47 | 4.65 | NA | NA | NA |
| 487 | 821 | ACATACGTCTT TGGTTTTAG | 2 | 2 | NC | NC | 70.72 | 35.34 | 6.48 | 2.24 | NA | NA | NA |
| 488 | 822 | AACATACGTC TTTGGTTTTA | 2 | 2 | NC | NC | 83.56 | 35.11 | 2.57 | 4.54 | NA | NA | NA |
| 489 | 823 | GAACATACGT CTTTGGTTTT | 2 | 2 | NC | NC | 81.77 | 57.14 | 4.53 | 10.08 | NA | NA | NA |
| 511 | 845 | TCCATAAATTT GACAAAATC | 2 | 1 | NC | NC | 96.45 | 23.33 | 3.53 | 3.81 | NA | NA | NA |
| 514 | 850 | CCCAATCCAT AAATTTGACA | 2 | 2 | NC | NC | 86.56 | 11.43 | 6.66 | 2.22 | NA | NA | NA |
| 515 | 851 | TCCCAATCCA TAAATTTGAC | 2 | 2 | NC | NC | 60.68 | 12.61 | 14.38 | 1.93 | 0.25 | 0.95 | 4.36 |
| 516 | 852 | TTCCCAATCC ATAAATTTGA | 2 | 1 | NC | NC | 75.59 | 15.97 | 2.48 | 1.98 | NA | NA | NA |
| 517 | 853 | TTTCCCAATCC ATAAATTTG | 2 | 1 | NC | NC | 87.53 | 18.38 | 2.99 | 4.84 | NA | NA | NA |
| 520 | 856 | GACTTTCCCA ATCCATAAAT | 2 | 2 | NC | NC | 80.81 | 39.33 | 2.85 | 2.22 | NA | NA | NA |
| 521 | 857 | GGACTTTCCC AATCCATAAA | 2 | 2 | NC | NC | 71.46 | 112.84 | 8.75 | 11.34 | NA | NA | NA |
| 566 | 955 | AACAAAAACT GCATATTCTT | 1 | 2 | 1 | 2 | 91.61 | 33.40 | 4.65 | 2.33 | NA | NA | NA |
| 567 | 956 | AAACAAAAACT GCATATTCT | 1 | 1 | 1 | 2 | 94.58 | 27.27 | 4.20 | 1.24 | NA | NA | NA |
| 568 | 957 | CAAACAAAAA CTGCATATTC | 2 | 2 | 2 | 1 | 89.77 | 24.51 | 3.48 | 2.37 | NA | NA | NA |
| 569 | 958 | ACAAACAAAA ACTGCATATT | 1 | 1 | 1 | 2 | 99.32 | 53.98 | 6.18 | 3.61 | NA | NA | NA |
| 573 | 962 | GTTCACAAAC AAAAACTGCA | 1 | 2 | 1 | 2 | 68.74 | 37.94 | 5.84 | 2.62 | NA | NA | NA |
| 591 | 991 | TGTAGCTTTGT CCTTAAAAC | 2 | 2 | NC | NC | 71.77 | 21.72 | 4.41 | 2.37 | NA | NA | NA |
| 593 | 993 | TATGTAGCTTT GTCCTTAAA | 2 | 2 | NC | NC | 74.13 | 15.76 | 5.06 | 5.42 | NA | NA | NA |
| 594 | 994 | TTATGTAGCTT TGTCCTTAA | 2 | 2 | NC | NC | 74.46 | 11.80 | 4.57 | 6.26 | 0.14 | 0.49 | 2.69 |
| 596 | 996 | GTTTATGTAG CTTTGTCCTT | 2 | 2 | NC | NC | 80.57 | 93.92 | 9.82 | 4.48 | NA | NA | NA |
| 598 | 998 | GAGTTTATGTA GCTTTGTCC | 2 | 2 | NC | NC | 71.72 | 57.48 | 4.63 | 6.60 | NA | NA | NA |
| 599 | 999 | TGAGTTTATGT AGCTTTGTC | 2 | 2 | NC | NC | 74.89 | 27.84 | 3.23 | 1.82 | NA | NA | NA |
| 600 | 1000 | ATGAGTTTATG TAGCTTTGT | 2 | 1 | NC | NC | 78.20 | 51.14 | 3.45 | 1.92 | NA | NA | NA |
| 602 | 1002 | CAATGAGTTTA TGTAGCTTT | 2 | 2 | NC | NC | 75.22 | 13.63 | 4.08 | 0.86 | NA | NA | NA |
| 666 | 1132 | CACTGCACAT TAATTACATA | 2 | 2 | NC | NC | 86.38 | 19.28 | 5.73 | 2.62 | NA | NA | NA |
| 667 | 1133 | GCACTGCACA TTAATTACAT | 2 | 1 | NC | NC | 83.35 | 96.52 | 4.00 | 4.57 | NA | NA | NA |
| 669 | 1135 | TGGCACTGCA CATTAATTAC | 2 | 2 | NC | NC | 88.48 | 15.35 | 20.54 | 2.58 | NA | NA | NA |
| 670 | 1136 | TTGGCACTGC ACATTAATTA | 2 | 2 | NC | NC | 80.34 | 19.46 | 4.68 | 0.91 | NA | NA | NA |
| 671 | 1137 | ATTGGCACTG CACATTAATT | 2 | 2 | NC | NC | 86.17 | 51.51 | 4.80 | 2.16 | NA | NA | NA |
| 701 | 1180 | ATCAGAGTTTT GGCTGGCTC | 2 | 2 | 2 | 2 | 69.02 | 35.95 | 2.06 | 3.49 | NA | NA | NA |
| 702 | 1181 | AATCAGAGTTT TGGCTGGCT | 2 | 2 | 2 | 2 | 63.90 | 39.92 | 1.63 | 4.52 | NA | NA | NA |
| 703 | 1182 | CAATCAGAGT TTTGGCTGGC | 2 | 2 | 2 | 2 | 65.26 | 26.28 | 2.95 | 3.50 | 0.07 | 0.23 | ND |
| 704 | 1183 | TCAATCAGAG TTTTGGCTGG | 2 | 2 | 2 | 2 | 71.61 | 34.85 | 3.07 | 2.52 | NA | NA | NA |
| 719 | 1204 | AGAGTGTCCC AGTTCTGAAA | 2 | 2 | NC | NC | 64.55 | 148.30 | 1.97 | 6.08 | NA | NA | NA |

TABLE 3-continued

Positive ASOs

| SEQ ID NO | Position | Sequence | Off-target Score Human | Cyno | Mouse | Rat | mean % mRNA remaining 2 nM | 20 nM | SD % mRNA remaining 2 nM | 20 nM | IC20 (nM) | IC50 (nM) | IC80 (nM) |
|---|---|---|---|---|---|---|---|---|---|---|---|---|---|
| 720 | 1205 | GAGAGTGTCC CAGTTCTGAA | 2 | 2 | NC | NC | 66.32 | 98.81 | 6.09 | 5.02 | NA | NA | NA |
| 721 | 1206 | AGAGAGTGTC CCAGTTCTGA | 2 | 2 | NC | NC | 62.41 | 75.95 | 1.14 | 25.39 | NA | NA | NA |
| 728 | 1213 | CAAAACAAGA GAGTGTCCCA | 2 | 1 | NC | NC | 76.06 | 13.81 | 12.21 | 1.67 | NA | NA | NA |
| 749 | 1234 | ATTTTCACTCC TTCCTGAAT | 2 | 1 | NC | NC | 81.05 | 40.09 | 3.41 | 4.01 | NA | NA | NA |
| 750 | 1235 | CATTTTCACTC CTTCCTGAA | 2 | 2 | NC | NC | 76.24 | 14.95 | 6.33 | 3.38 | NA | NA | NA |
| 751 | 1236 | ACATTTTCACT CCTTCCTGA | 2 | 2 | NC | NC | 69.48 | 15.51 | 9.75 | 1.75 | 0.39 | 1.41 | ND |
| 752 | 1237 | AACATTTTCAC TCCTTCCTG | 2 | 2 | NC | NC | 70.68 | 13.87 | 2.65 | 1.57 | 0.39 | 1.07 | 8.02 |
| 753 | 1238 | AAACATTTTCA CTCCTTCCT | 2 | 2 | NC | NC | 75.55 | 11.15 | 3.73 | 1.12 | 0.57 | 1.84 | 7.69 |
| 755 | 1240 | AAAAACATTTT CACTCCTTC | 2 | 1 | NC | NC | 79.25 | 13.25 | 6.99 | 1.87 | NA | NA | NA |
| 757 | 1242 | TTAAAAACATT TTCACTCCT | 2 | 1 | NC | NC | 82.65 | 17.72 | 6.24 | 2.56 | NA | NA | NA |
| 784 | 1290 | ATTCCTTAATA TCCTCACCT | 2 | 2 | NC | NC | 78.04 | 15.48 | 5.23 | 0.95 | NA | NA | NA |
| 786 | 1292 | AAATTCCTTAA TATCCTCAC | 2 | 2 | NC | NC | 81.35 | 17.87 | 5.88 | 2.23 | NA | NA | NA |
| 787 | 1293 | TAAATTCCTTA ATATCCTCA | 2 | 2 | NC | NC | 83.49 | 23.29 | 3.85 | 4.04 | NA | NA | NA |
| 788 | 1294 | CTAAATTCCTT AATATCCTC | 2 | 2 | NC | NC | 77.48 | 26.26 | 3.28 | 2.35 | NA | NA | NA |
| 790 | 1296 | CACTAAATTCC TTAATATCC | 2 | 2 | NC | NC | 82.57 | 31.46 | 2.87 | 2.53 | NA | NA | NA |
| 828 | 1354 | TCATCGGAAG TCACACGCTT | 2 | 3 | NC | NC | 67.51 | 11.20 | 3.20 | 1.82 | 0.22 | 0.77 | 4.29 |
| 829 | 1355 | CTCATCGGAA GTCACACGCT | 2 | 2 | NC | NC | 68.94 | 15.81 | 3.19 | 1.49 | 0.19 | 0.67 | 3.18 |
| 830 | 1356 | TCTCATCGGA AGTCACACGC | 2 | 2 | NC | NC | 73.66 | 14.18 | 2.63 | 3.48 | 0.17 | 0.69 | 3.43 |
| 959 | 1539 | GACCACCTGA TTCATAAATG | 2 | 2 | NC | NC | 69.12 | 47.95 | 6.78 | 11.48 | NA | NA | NA |
| 960 | 1540 | GGACCACCTG ATTCATAAAT | 2 | 2 | NC | NC | 79.02 | 206.94 | 4.65 | 56.26 | NA | NA | NA |
| 961 | 1542 | CTGGACCACC TGATTCATAA | 2 | 2 | NC | NC | 79.65 | 55.49 | 7.13 | 4.02 | NA | NA | NA |
| 964 | 1563 | GCTCTGTCAT TTTGCTATGG | 2 | 2 | NC | NC | 77.42 | 70.22 | 1.40 | 2.14 | NA | NA | NA |
| 965 | 1564 | GGCTCTGTCA TTTTGCTATG | 2 | 2 | NC | NC | 78.46 | 81.64 | 2.58 | 1.06 | NA | NA | NA |
| 967 | 1566 | ATGGCTCTGT CATTTTGCTA | 2 | 2 | NC | NC | 77.47 | 50.42 | 1.09 | 1.68 | NA | NA | NA |
| 968 | 1567 | GATGGCTCTG TCATTTTGCT | 2 | 2 | NC | NC | 75.71 | 104.49 | 3.59 | 15.27 | NA | NA | NA |
| 971 | 1570 | AAAGATGGCT CTGTCATTTT | 2 | 2 | NC | NC | 85.42 | 51.21 | 4.94 | 0.57 | NA | NA | NA |
| 972 | 1571 | TAAAGATGGC TCTGTCATTT | 2 | 2 | NC | NC | 71.44 | 16.26 | 18.64 | 2.69 | NA | NA | NA |
| 973 | 1572 | GTAAAGATGG CTCTGTCATT | 2 | 2 | NC | NC | 85.49 | 84.58 | 2.18 | 10.18 | NA | NA | NA |
| 974 | 1573 | TGTAAAGATG GCTCTGTCAT | 2 | 2 | NC | NC | 87.95 | 17.81 | 3.14 | 1.82 | NA | NA | NA |
| 975 | 1574 | TTGTAAAGAT GGCTCTGTCA | 2 | 2 | NC | NC | 88.69 | 14.78 | 0.99 | 1.26 | NA | NA | NA |
| 976 | 1575 | TTTGTAAAGAT GGCTCTGTC | 2 | 2 | NC | NC | 86.84 | 14.94 | 1.99 | 2.71 | NA | NA | NA |
| 977 | 1576 | TTTTGTAAAGA TGGCTCTGT | 2 | 2 | NC | NC | 90.05 | 17.51 | 1.81 | 3.62 | NA | NA | NA |
| 986 | 1588 | GAGCTGTCTT TGTTTTGTAA | 2 | 2 | NC | NC | 80.81 | 130.73 | 2.60 | 8.33 | NA | NA | NA |
| 987 | 1589 | AGAGCTGTCT TTGTTTTGTA | 2 | 2 | NC | NC | 78.87 | 83.79 | 2.43 | 6.83 | NA | NA | NA |
| 1002 | 1626 | CAATTGTCTCT TGTTCTAAC | 2 | 2 | NC | NC | 77.84 | 12.02 | 5.97 | 2.15 | NA | NA | NA |
| 1003 | 1627 | ACAATTGTCTC TTGTTCTAA | 2 | 1 | NC | NC | 86.71 | 66.67 | 3.79 | 3.42 | NA | NA | NA |

TABLE 3-continued

Positive ASOs

| SEQ ID NO | Posi-tion | Sequence | Off-target Score Human | Cyno | Mouse | Rat | mean % mRNA remaining 2 nM | 20 nM | SD % mRNA remaining 2 nM | 20 nM | IC20 (nM) | IC50 (nM) | IC80 (nM) |
|---|---|---|---|---|---|---|---|---|---|---|---|---|---|
| 1004 | 1628 | TACAATTGTCT CTTGTTCTA | 2 | 2 | NC | NC | 77.06 | 24.92 | 4.21 | 2.75 | NA | NA | NA |
| 1005 | 1629 | CTACAATTGTC TCTTGTTCT | 2 | 2 | NC | NC | 71.10 | 17.61 | 3.81 | 3.54 | 0.14 | 0.48 | 2.52 |
| 1006 | 1630 | GCTACAATTG TCTCTTGTTC | 2 | 2 | NC | NC | 75.21 | 164.15 | 3.53 | 7.38 | NA | NA | NA |
| 1007 | 1631 | TGCTACAATT GTCTCTTGTT | 2 | 2 | NC | NC | 68.01 | 43.68 | 5.57 | 3.18 | NA | NA | NA |
| 1008 | 1633 | GATGCTACAA TTGTCTCTTG | 2 | 2 | NC | NC | 76.75 | 157.84 | 4.28 | 14.35 | NA | NA | NA |
| 1009 | 1634 | TGATGCTACA ATTGTCTCTT | 2 | 2 | NC | NC | 93.24 | 19.27 | 32.66 | 1.18 | NA | NA | NA |
| 1010 | 1635 | CTGATGCTAC AATTGTCTCT | 2 | 2 | NC | NC | 79.27 | 34.33 | 2.33 | 1.43 | NA | NA | NA |
| 1011 | 1636 | TCTGATGCTA CAATTGTCTC | 2 | 1 | NC | NC | 74.33 | 26.98 | 3.75 | 2.56 | NA | NA | NA |
| 1012 | 1637 | TTCTGATGCTA CAATTGTCT | 2 | 1 | NC | NC | 74.47 | 19.62 | 3.96 | 6.13 | NA | NA | NA |
| 1013 | 1638 | CTTCTGATGC TACAATTGTC | 2 | 2 | NC | NC | 76.90 | 39.77 | 1.15 | 4.56 | NA | NA | NA |
| 1014 | 1639 | GCTTCTGATG CTACAATTGT | 2 | 2 | NC | NC | 72.48 | 113.69 | 5.55 | 8.85 | NA | NA | NA |
| 1086 | 1742 | TGGTGTCTGA AAAGGGCTTA | 2 | 2 | NC | NC | 75.01 | 41.17 | 4.46 | 5.94 | NA | NA | NA |
| 1110 | 1785 | CTTTCCATATT TCTAGATCC | 2 | 2 | NC | NC | 85.18 | 26.06 | 2.72 | 2.17 | NA | NA | NA |
| 1111 | 1786 | TCTTTCCATAT TTCTAGATC | 2 | 2 | NC | NC | 78.80 | 27.68 | 3.78 | 2.79 | NA | NA | NA |
| 1121 | 1796 | AGTAGTACTTT CTTTCCATA | 2 | 2 | NC | NC | 80.48 | 64.18 | 2.34 | 2.76 | NA | NA | NA |
| 1126 | 1801 | TTAACAGTAGT ACTTTCTTT | 2 | 2 | NC | NC | 84.35 | 22.72 | 2.03 | 2.88 | NA | NA | NA |
| 1127 | 1802 | ATTAACAGTA GTACTTTCTT | 2 | 2 | NC | NC | 55.07 | 79.59 | 34.67 | 5.19 | NA | NA | NA |
| 1147 | 1848 | GTTGATTCTG AATTCTATTA | 2 | 2 | NC | NC | 69.33 | 128.16 | 3.03 | 3.50 | NA | NA | NA |
| 1148 | 1849 | GGTTGATTCT GAATTCTATT | 2 | 2 | NC | NC | 65.93 | 188.28 | 4.48 | 11.46 | NA | NA | NA |
| 1149 | 1850 | TGGTTGATTCT GAATTCTAT | 2 | 2 | NC | NC | 69.18 | 44.46 | 4.72 | 7.24 | NA | NA | NA |
| 1172 | 1873 | TCAGTAGCAT CTTTAAATCT | 2 | 1 | NC | NC | 74.20 | 20.17 | 5.52 | 2.86 | NA | NA | NA |
| 1175 | 1876 | ACTTCAGTAG CATCTTTAAA | 2 | 2 | NC | NC | 78.49 | 123.59 | 4.03 | 9.36 | NA | NA | NA |
| 1176 | 1877 | CACTTCAGTA GCATCTTTAA | 2 | 1 | NC | NC | 75.25 | 11.77 | 5.40 | 1.32 | 0.69 | 2.09 | 8.02 |
| 1177 | 1878 | CCACTTCAGT AGCATCTTTA | 2 | 2 | NC | NC | 68.95 | 8.07 | 4.38 | 0.39 | 0.14 | 0.58 | 3.80 |
| 1178 | 1879 | CCCACTTCAG TAGCATCTTT | 2 | 2 | NC | NC | 65.87 | 8.11 | 2.09 | 1.80 | 0.10 | 0.39 | 1.99 |
| 1179 | 1880 | TCCCACTTCA GTAGCATCTT | 2 | 2 | NC | NC | 67.23 | 10.92 | 2.21 | 3.12 | 0.15 | 0.54 | 2.51 |
| 1180 | 1881 | ATCCCACTTC AGTAGCATCT | 2 | 2 | NC | NC | 67.00 | 18.94 | 2.11 | 2.86 | 0.04 | 0.28 | 2.14 |
| 1181 | 1882 | CATCCCACTT CAGTAGCATC | 2 | 2 | NC | NC | 71.78 | 20.23 | 2.13 | 1.55 | NA | NA | NA |
| 1182 | 1883 | GCATCCCACT TCAGTAGCAT | 2 | 2 | NC | NC | 68.68 | 114.92 | 2.54 | 10.08 | NA | NA | NA |
| 1183 | 1884 | GGCATCCCAC TTCAGTAGCA | 2 | 2 | NC | NC | 72.93 | 113.70 | 11.52 | 21.89 | NA | NA | NA |
| 1184 | 1885 | TGGCATCCCA CTTCAGTAGC | 2 | 2 | NC | NC | 69.63 | 69.40 | 4.84 | 3.66 | NA | NA | NA |
| 1185 | 1886 | CTGGCATCCC ACTTCAGTAG | 2 | 2 | NC | NC | 72.14 | 45.78 | 4.09 | 2.59 | NA | NA | NA |
| 1186 | 1887 | GCTGGCATCC CACTTCAGTA | 2 | 2 | NC | NC | 69.71 | 65.90 | 4.70 | 2.86 | NA | NA | NA |
| 1260 | 2029 | TGAGTTATAAA GCCAGTGGA | 2 | 1 | 2 | NC | 68.42 | 47.42 | 4.50 | 2.18 | NA | NA | NA |
| 1261 | 2030 | ATGAGTTATAA AGCCAGTGG | 2 | 2 | 2 | NC | 72.80 | 57.12 | 0.99 | 3.07 | NA | NA | NA |
| 1270 | 2065 | GTTTCAGTTG ATTTAGTTTT | 2 | 2 | NC | NC | 78.59 | 106.70 | 2.25 | 29.03 | NA | NA | NA |

TABLE 3-continued

Positive ASOs

| SEQ ID NO | Position | Sequence | Off-target Score Human | Cyno | Mouse | Rat | mean % mRNA remaining 2 nM | 20 nM | SD % mRNA remaining 2 nM | 20 nM | IC20 (nM) | IC50 (nM) | IC80 (nM) |
|---|---|---|---|---|---|---|---|---|---|---|---|---|---|
| 1271 | 2066 | TGTTTCAGTTGATTTAGTTT | 2 | 1 | NC | NC | 82.53 | 32.40 | 3.39 | 4.98 | NA | NA | NA |
| 1272 | 2067 | CTGTTTCAGTTGATTTAGTT | 2 | 2 | NC | NC | 76.30 | 24.47 | 2.77 | 5.14 | NA | NA | NA |
| 1273 | 2068 | TCTGTTTCAGTTGATTTAGT | 2 | 2 | NC | NC | 68.38 | 27.94 | 14.27 | 2.36 | NA | NA | NA |
| 1274 | 2069 | TTCTGTTTCAGTTGATTTAG | 2 | 1 | 2 | NC | 76.46 | 12.90 | 6.14 | 0.77 | 0.38 | 1.13 | 4.72 |
| 1275 | 2070 | GTTCTGTTTCAGTTGATTTA | 2 | 2 | 2 | NC | 66.45 | 118.07 | 4.03 | 5.40 | NA | NA | NA |
| 1276 | 2071 | TGTTCTGTTTCAGTTGATTT | 1 | 1 | 1 | NC | 65.68 | 30.63 | 2.73 | 0.37 | NA | NA | NA |
| 1277 | 2072 | ATGTTCTGTTTCAGTTGATT | 1 | 1 | 2 | NC | 65.66 | 34.51 | 2.06 | 1.78 | NA | NA | NA |
| 1297 | 2118 | TTTCTTGGGCACGTGTGGGA | 2 | 1 | NC | NC | 61.03 | 18.52 | 6.51 | 2.34 | 0.05 | 0.31 | 2.96 |
| 1300 | 2122 | AATGTTTCTTGGGCACGTGT | 2 | 2 | NC | NC | 60.38 | 53.85 | 2.71 | 9.00 | NA | NA | NA |
| 1302 | 2124 | CAAATGTTTCTTGGGCACGT | 2 | 2 | NC | NC | 50.98 | 16.06 | 15.03 | 2.05 | 0.14 | 0.41 | 2.23 |
| 1310 | 2138 | ACGTGTTCTATTTCCAAATG | 2 | 2 | NC | NC | 73.53 | 79.81 | 8.72 | 2.83 | NA | NA | NA |
| 1387 | 2259 | TAGGTTCATTCTCTAGCCCA | 2 | 2 | NC | NC | 63.57 | 12.33 | 1.67 | 1.91 | 0.03 | 0.14 | 1.04 |
| 1388 | 2260 | GTAGGTTCATTCTCTAGCCC | 2 | 2 | NC | NC | 69.80 | 48.38 | 3.08 | 0.78 | NA | NA | NA |
| 1389 | 2261 | TGTAGGTTCATTCTCTAGCC | 2 | 2 | NC | NC | 69.61 | 45.78 | 2.74 | 9.52 | NA | NA | NA |
| 1390 | 2262 | CTGTAGGTTCATTCTCTAGC | 2 | 2 | NC | NC | 71.89 | 31.39 | 7.34 | 2.62 | NA | NA | NA |
| 1391 | 2263 | GCTGTAGGTTCATTCTCTAG | 2 | 2 | NC | NC | 73.44 | 130.40 | 5.21 | 13.47 | NA | NA | NA |
| 1392 | 2264 | TGCTGTAGGTTCATTCTCTA | 2 | 2 | NC | NC | 68.83 | 29.39 | 10.26 | 1.58 | NA | NA | NA |
| 1393 | 2265 | TTGCTGTAGGTTCATTCTCT | 2 | 2 | NC | NC | 64.56 | 18.57 | 5.04 | 1.50 | 0.05 | 0.23 | 2.96 |
| 1394 | 2266 | GTTGCTGTAGGTTCATTCTC | 2 | 2 | NC | NC | 70.73 | 117.81 | 5.81 | 15.37 | NA | NA | NA |
| 1395 | 2267 | AGTTGCTGTAGGTTCATTCT | 2 | 2 | NC | NC | 70.69 | 95.10 | 3.97 | 10.79 | NA | NA | NA |
| 1396 | 2268 | AAGTTGCTGTAGGTTCATTC | 2 | 2 | NC | NC | 69.93 | 42.84 | 2.50 | 9.05 | NA | NA | NA |
| 1461 | 2390 | ATCTGTTTTCCTACTATCAT | 2 | 2 | NC | NC | 78.96 | 23.24 | 5.39 | 2.08 | NA | NA | NA |
| 1462 | 2391 | TATCTGTTTTCCTACTATCA | 2 | 2 | NC | NC | 73.74 | 13.91 | 4.95 | 2.57 | NA | NA | NA |
| 1463 | 2392 | TTATCTGTTTTCCTACTATC | 2 | 2 | NC | NC | 61.32 | 12.11 | 19.41 | 2.41 | 0.54 | 1.28 | 3.42 |
| 1473 | 2424 | TACGGACGATTGGTTTGGAG | 2 | 3 | NC | NC | 64.86 | 42.49 | 2.84 | 8.14 | NA | NA | NA |
| 1474 | 2425 | TTACGGACGATTGGTTTGGA | 3 | 3 | NC | NC | 74.71 | 28.87 | 4.48 | 1.96 | NA | NA | NA |
| 1482 | 2433 | TTAGCTTCTTACGGACGATT | 2 | 2 | NC | NC | 73.20 | 16.43 | 1.80 | 2.24 | NA | NA | NA |
| 1485 | 2436 | AGCTTAGCTTCTTACGGACG | 2 | 3 | NC | NC | 67.08 | 81.14 | 3.07 | 4.19 | NA | NA | NA |
| 1486 | 2448 | GCTGTGAACTCAAGCTTAGC | 3 | 3 | NC | NC | 68.69 | 128.36 | 1.70 | 2.50 | NA | NA | NA |
| 1487 | 2449 | AGCTGTGAACTCAAGCTTAG | 2 | 2 | NC | NC | 70.69 | 62.48 | 4.99 | 4.34 | NA | NA | NA |
| 1490 | 2453 | TCCTAGCTGTGAACTCAAGC | 2 | 2 | NC | NC | 70.82 | 39.13 | 4.00 | 3.11 | NA | NA | NA |
| 1491 | 2454 | ATCCTAGCTGTGAACTCAAG | 2 | 2 | NC | NC | 73.02 | 39.97 | 2.91 | 6.24 | NA | NA | NA |
| 1492 | 2455 | GATCCTAGCTGTGAACTCAA | 2 | 2 | NC | NC | 70.55 | 60.81 | 1.82 | 6.58 | NA | NA | NA |
| 1493 | 2456 | AGATCCTAGCTGTGAACTCA | 2 | 2 | NC | NC | 71.35 | 60.70 | 3.51 | 5.37 | NA | NA | NA |
| 1494 | 2457 | AAGATCCTAGCTGTGAACTC | 2 | 2 | NC | NC | 72.72 | 51.80 | 3.01 | 3.51 | NA | NA | NA |
| 1495 | 2458 | AAAGATCCTAGCTGTGAACT | 2 | 2 | NC | NC | 79.93 | 49.47 | 2.18 | 1.51 | NA | NA | NA |

TABLE 3-continued

Positive ASOs

| SEQ ID NO | Position | Sequence | Off-target Score Human | Cyno | Mouse | Rat | mean % mRNA remaining 2 nM | 20 nM | SD % mRNA remaining 2 nM | 20 nM | IC20 (nM) | IC50 (nM) | IC80 (nM) |
|---|---|---|---|---|---|---|---|---|---|---|---|---|---|
| 1498 | 2461 | TCTAAAGATCCTAGCTGTGA | 2 | 2 | NC | NC | 74.47 | 23.80 | 5.24 | 0.46 | NA | NA | NA |
| 1499 | 2462 | CTCTAAAGATCCTAGCTGTG | 2 | 2 | NC | NC | 69.91 | 27.63 | 6.82 | 2.73 | NA | NA | NA |
| 1500 | 2463 | TCTCTAAAGATCCTAGCTGT | 2 | 2 | NC | NC | 75.81 | 26.67 | 2.37 | 1.97 | NA | NA | NA |
| 1501 | 2464 | TTCTCTAAAGATCCTAGCTG | 2 | 2 | NC | NC | 78.09 | 38.79 | 2.41 | 3.40 | NA | NA | NA |
| 1502 | 2465 | CTTCTCTAAAGATCCTAGCT | 2 | 2 | NC | NC | 68.81 | 22.90 | 6.78 | 1.92 | NA | NA | NA |
| 1505 | 2468 | AAACTTCTCTAAAGATCCTA | 2 | 2 | NC | NC | 86.60 | 24.26 | 4.80 | 1.82 | NA | NA | NA |
| 1508 | 2471 | CTTAAACTTCTCTAAAGATC | 2 | 2 | NC | NC | 84.65 | 17.74 | 3.17 | 2.47 | NA | NA | NA |
| 1510 | 2473 | CTCTTAAACTTCTCTAAAGA | 2 | 1 | 1 | 2 | 87.47 | 13.20 | 6.48 | 0.80 | NA | NA | NA |
| 1511 | 2474 | CCTCTTAAACTTCTCTAAAG | 1 | 1 | 2 | 2 | 73.37 | 15.35 | 5.97 | 2.14 | 0.16 | 0.81 | 4.45 |
| 1512 | 2475 | GCCTCTTAAACTTCTCTAAA | 2 | 1 | 2 | 2 | 72.85 | 31.27 | 2.89 | 1.55 | NA | NA | NA |
| 1513 | 2476 | TGCCTCTTAAACTTCTCTAA | 2 | 1 | 1 | 2 | 79.53 | 42.74 | 13.31 | 3.65 | NA | NA | NA |
| 1514 | 2477 | TTGCCTCTTAAACTTCTCTA | 2 | 1 | NC | NC | 73.71 | 11.85 | 2.24 | 1.40 | 0.02 | 0.38 | 5.13 |
| 1516 | 2479 | TATTGCCTCTTAAACTTCTC | 2 | 2 | NC | NC | 79.30 | 16.65 | 3.72 | 3.94 | NA | NA | NA |
| 1517 | 2480 | ATATTGCCTCTTAAACTTCT | 2 | 2 | NC | NC | 76.59 | 29.78 | 5.84 | 1.81 | NA | NA | NA |
| 1518 | 2481 | CATATTGCCTCTTAAACTTC | 2 | 2 | NC | NC | 86.67 | 17.75 | 3.02 | 3.06 | NA | NA | NA |
| 1525 | 2488 | ACCTTCCCATATTGCCTCTT | 2 | 2 | NC | NC | 72.28 | 28.62 | 1.91 | 3.82 | NA | NA | NA |
| 1526 | 2489 | AACCTTCCCATATTGCCTCT | 2 | 2 | NC | NC | 70.59 | 19.06 | 1.32 | 7.43 | NA | NA | NA |
| 1529 | 2492 | TTCAACCTTCCCATATTGCC | 2 | 2 | NC | NC | 74.01 | 13.77 | 5.21 | 2.28 | NA | NA | NA |
| 1530 | 2493 | TTTCAACCTTCCCATATTGC | 2 | 2 | NC | NC | 81.55 | 13.64 | 6.64 | 1.18 | NA | NA | NA |
| 1546 | 2519 | TTCCTCTACTTCTGTATCCA | 2 | 2 | NC | NC | 84.26 | 19.50 | 4.19 | 5.90 | NA | NA | NA |
| 1547 | 2520 | TTTCCTCTACTTCTGTATCC | 2 | 2 | NC | NC | 85.00 | 20.32 | 5.40 | 3.25 | NA | NA | NA |
| 1572 | 2545 | CTGAGATTGGTAGTGACTCC | 2 | 3 | NC | NC | 68.27 | 28.46 | 7.17 | 0.96 | NA | NA | NA |
| 1573 | 2546 | ACTGAGATTGGTAGTGACTC | 2 | 3 | NC | NC | 69.11 | 52.86 | 6.10 | 3.94 | NA | NA | NA |
| 1574 | 2547 | GACTGAGATTGGTAGTGACT | 2 | 2 | NC | NC | 78.60 | 50.74 | 8.80 | 2.24 | NA | NA | NA |
| 1595 | 2568 | GAATGTCAGGTTCAACTTGA | 2 | 2 | NC | NC | 78.06 | 56.47 | 5.71 | 10.65 | NA | NA | NA |
| 1596 | 2569 | AGAATGTCAGGTTCAACTTG | 2 | 2 | NC | NC | 77.01 | 48.82 | 4.77 | 4.06 | NA | NA | NA |
| 1597 | 2570 | CAGAATGTCAGGTTCAACTT | 2 | 2 | NC | NC | 74.20 | 17.39 | 4.52 | 1.90 | NA | NA | NA |
| 1721 | 2730 | TAGGCATCTGTTGTTCTAAA | 2 | 2 | NC | NC | 73.06 | 21.72 | 4.85 | 2.93 | NA | NA | NA |
| 1722 | 2731 | CTAGGCATCTGTTGTTCTAA | 2 | 2 | NC | NC | 68.46 | 20.27 | 3.55 | 1.95 | NA | NA | NA |
| 1723 | 2732 | ACTAGGCATCTGTTGTTCTA | 2 | 3 | NC | NC | 75.00 | 69.45 | 1.93 | 7.25 | NA | NA | NA |
| 1724 | 2733 | AACTAGGCATCTGTTGTTCT | 2 | 2 | NC | NC | 76.27 | 33.88 | 5.64 | 1.90 | NA | NA | NA |
| 1725 | 2734 | AAACTAGGCATCTGTTGTTC | 2 | 2 | NC | NC | 70.43 | 26.81 | 24.22 | 2.05 | NA | NA | NA |
| 1726 | 2735 | CAAACTAGGCATCTGTTGTT | 2 | 1 | NC | NC | 77.29 | 14.21 | 1.87 | 1.23 | NA | NA | NA |
| 1727 | 2736 | TCAAACTAGGCATCTGTTGT | 2 | 2 | NC | NC | 80.67 | 14.87 | 3.79 | 1.40 | NA | NA | NA |
| 1744 | 2764 | AACTCCTTCAGGGTCATAGG | 2 | 2 | NC | NC | 66.84 | 32.00 | 3.65 | 2.80 | NA | NA | NA |
| 1745 | 2765 | TAACTCCTTCAGGGTCATAG | 2 | 2 | NC | NC | 74.04 | 9.12 | 3.74 | 1.45 | 0.34 | 1.20 | 4.67 |

TABLE 3-continued

Positive ASOs

| SEQ ID NO | Position | Sequence | Off-target Score Human | Cyno | Mouse | Rat | mean % mRNA remaining 2 nM | 20 nM | SD % mRNA remaining 2 nM | 20 nM | IC20 (nM) | IC50 (nM) | IC80 (nM) |
|---|---|---|---|---|---|---|---|---|---|---|---|---|---|
| 1746 | 2766 | ATAACTCCTTC AGGGTCATA | 2 | 2 | NC | NC | 86.21 | 14.10 | 4.66 | 3.64 | NA | NA | NA |
| 1747 | 2767 | GATAACTCCTT CAGGGTCAT | 2 | 2 | NC | NC | 73.17 | 71.61 | 4.49 | 4.91 | NA | NA | NA |
| 1748 | 2768 | AGATAACTCC TTCAGGGTCA | 2 | 2 | NC | NC | 76.10 | 58.88 | 4.53 | 4.26 | NA | NA | NA |
| 1786 | 2818 | GCTAGTGATT CAGATGACTT | 2 | 2 | NC | NC | 77.18 | 61.81 | 6.95 | 4.16 | NA | NA | NA |
| 1797 | 2829 | ATAATTTAGAG GCTAGTGAT | 2 | 2 | NC | NC | 94.05 | 34.62 | 8.58 | 2.35 | NA | NA | NA |
| 1799 | 2831 | GGATAATTTA GAGGCTAGTG | 2 | 2 | NC | NC | 75.22 | 65.82 | 7.97 | 3.21 | NA | NA | NA |
| 1800 | 2832 | TGGATAATTTA GAGGCTAGT | 3 | 3 | NC | NC | 79.60 | 28.73 | 5.81 | 2.69 | NA | NA | NA |
| 1801 | 2833 | CTGGATAATTT AGAGGCTAG | 2 | 2 | NC | NC | 77.03 | 22.93 | 6.10 | 1.34 | NA | NA | NA |
| 1802 | 2834 | TCTGGATAATT TAGAGGCTA | 2 | 2 | NC | NC | 78.17 | 49.18 | 6.44 | 2.39 | NA | NA | NA |
| 1824 | 2856 | TTTCTCTTTCG GAACCCTTC | 3 | 2 | NC | NC | 79.87 | 5.65 | 7.71 | 0.67 | 0.43 | 1.29 | 4.72 |
| 1825 | 2857 | GTTTCTCTTTC GGAACCCTT | 2 | 2 | NC | NC | 75.83 | 33.27 | 3.68 | 1.25 | NA | NA | NA |
| 1826 | 2858 | AGTTTCTCTTT CGGAACCCT | 2 | 2 | NC | NC | 76.81 | 34.76 | 5.54 | 3.44 | NA | NA | NA |
| 1831 | 2863 | GTTTGAGTTTC TCTTTCGGA | 2 | 2 | NC | NC | 67.51 | 72.93 | 1.34 | 4.78 | NA | NA | NA |
| 1832 | 2864 | TGTTTGAGTTT CTCTTTCGG | 2 | 2 | NC | NC | 66.75 | 29.27 | 2.81 | 1.55 | NA | NA | NA |
| 1835 | 2867 | CATTGTTTGA GTTTCTCTTT | 2 | 2 | NC | NC | 75.22 | 20.20 | 5.27 | 3.46 | NA | NA | NA |
| 1836 | 2868 | CCATTGTTTGA GTTTCTCTT | 2 | 2 | NC | NC | 71.49 | 16.43 | 3.31 | 0.78 | NA | NA | NA |
| 1859 | 2891 | TTCATTAAAAC GACTCATCA | 2 | 2 | NC | NC | 91.66 | 16.04 | 2.16 | 1.84 | NA | NA | NA |
| 1860 | 2892 | GTTCATTAAAA CGACTCATC | 2 | 2 | NC | NC | 77.55 | 62.84 | 1.74 | 4.67 | NA | NA | NA |
| 1861 | 2893 | AGTTCATTAAA ACGACTCAT | 2 | 2 | NC | NC | 69.23 | 66.80 | 27.11 | 3.31 | NA | NA | NA |
| 1862 | 2894 | AAGTTCATTAA AACGACTCA | 2 | 2 | NC | NC | 84.65 | 51.64 | 7.39 | 1.43 | NA | NA | NA |
| 1865 | 2897 | TGGAAGTTCA TTAAAACGAC | 3 | 3 | NC | NC | 88.69 | 46.47 | 35.27 | 8.33 | NA | NA | NA |
| 1866 | 2898 | TTGGAAGTTC ATTAAAACGA | 2 | 2 | NC | NC | 71.25 | 26.95 | 4.16 | 3.49 | NA | NA | NA |
| 1869 | 2902 | GAATTTGGAA GTTCATTAAA | 2 | 2 | NC | NC | 86.52 | 58.00 | 3.96 | 4.41 | NA | NA | NA |
| 1870 | 2903 | TGAATTTGGA AGTTCATTAA | 2 | 2 | NC | NC | 90.65 | 27.21 | 4.10 | 5.36 | NA | NA | NA |
| 1871 | 2904 | CTGAATTTGG AAGTTCATTA | 2 | 2 | NC | NC | 75.35 | 14.63 | 1.81 | 2.65 | NA | NA | NA |
| 1872 | 2905 | TCTGAATTTG GAAGTTCATT | 2 | 1 | NC | NC | 84.12 | 14.91 | 23.88 | 3.23 | NA | NA | NA |
| 1873 | 2906 | ATCTGAATTTG GAAGTTCAT | 2 | 2 | NC | NC | 71.15 | 36.46 | 4.06 | 2.57 | NA | NA | NA |
| 1875 | 2908 | GAATCTGAATT TGGAAGTTC | 2 | 2 | NC | NC | 70.90 | 45.27 | 2.36 | 2.44 | NA | NA | NA |
| 1878 | 2911 | CTGGAATCTG AATTTGGAAG | 2 | 2 | NC | NC | 68.83 | 25.87 | 1.50 | 1.22 | NA | NA | NA |
| 1879 | 2912 | ACTGGAATCT GAATTTGGAA | 2 | 2 | NC | NC | 62.97 | 111.52 | 22.17 | 6.89 | NA | NA | NA |
| 1880 | 2913 | TACTGGAATC TGAATTTGGA | 2 | 2 | NC | NC | 67.96 | 25.92 | 4.97 | 1.56 | NA | NA | NA |
| 1881 | 2914 | CTACTGGAAT CTGAATTTGG | 2 | 2 | NC | NC | 68.54 | 17.06 | 2.52 | 1.28 | 0.22 | 0.86 | 4.29 |
| 1882 | 2915 | CCTACTGGAA TCTGAATTTG | 2 | 2 | NC | NC | 73.57 | 27.67 | 6.55 | 1.77 | NA | NA | NA |
| 1892 | 2957 | ACAAAAATCTT GTGTTAACA | 2 | 2 | NC | NC | 89.43 | 78.75 | 5.59 | 1.97 | NA | NA | NA |
| 1906 | 3003 | GGATGACACC ATTCTCTGTT | 2 | 3 | NC | NC | 70.86 | 222.24 | 1.88 | 14.27 | NA | NA | NA |
| 1907 | 3004 | GGGATGACAC CATTCTCTGT | 2 | 2 | NC | NC | 76.49 | 280.50 | 3.49 | 7.46 | NA | NA | NA |

TABLE 3-continued

Positive ASOs

| SEQ ID NO | Position | Sequence | Off-target Score Human | Cyno | Mouse | Rat | mean % mRNA remaining 2 nM | 20 nM | SD % mRNA remaining 2 nM | 20 nM | IC20 (nM) | IC50 (nM) | IC80 (nM) |
|---|---|---|---|---|---|---|---|---|---|---|---|---|---|
| 1908 | 3005 | TGGGATGACACCATTCTCTG | 2 | 2 | NC | NC | 68.03 | 76.92 | 5.51 | 2.43 | NA | NA | NA |
| 1910 | 3007 | GTTGGGATGACACCATTCTC | 2 | 2 | NC | NC | 73.32 | 93.25 | 5.01 | 10.64 | NA | NA | NA |
| 1911 | 3008 | TGTTGGGATGACACCATTCT | 2 | 2 | NC | NC | 76.23 | 48.47 | 6.77 | 1.44 | NA | NA | NA |
| 1912 | 3009 | ATGTTGGGATGACACCATTC | 2 | 2 | NC | NC | 72.48 | 66.65 | 3.78 | 1.22 | NA | NA | NA |
| 1913 | 3010 | GATGTTGGGATGACACCATT | 2 | 3 | NC | NC | 72.20 | 97.94 | 3.79 | 9.05 | NA | NA | NA |
| 1914 | 3011 | TGATGTTGGGATGACACCAT | 2 | 2 | NC | NC | 69.42 | 43.57 | 2.16 | 3.03 | NA | NA | NA |
| 1915 | 3012 | CTGATGTTGGGATGACACCA | 2 | 2 | NC | NC | 72.15 | 33.77 | 5.50 | 1.85 | NA | NA | NA |
| 1916 | 3013 | TCTGATGTTGGGATGACACC | 2 | 2 | NC | NC | 77.50 | 27.52 | 2.90 | 2.27 | NA | NA | NA |
| 1917 | 3014 | ATCTGATGTTGGGATGACAC | 2 | 2 | NC | NC | 78.06 | 35.90 | 1.79 | 3.12 | NA | NA | NA |
| 1918 | 3015 | AATCTGATGTTGGGATGACA | 2 | 2 | NC | NC | 79.81 | 45.61 | 4.85 | 2.12 | NA | NA | NA |
| 1922 | 3019 | GCAGAATCTGATGTTGGGAT | 2 | 2 | NC | NC | 80.19 | 72.76 | 4.80 | 2.76 | NA | NA | NA |
| 1923 | 3020 | GGCAGAATCTGATGTTGGGA | 2 | 2 | NC | NC | 75.56 | 82.00 | 4.49 | 7.01 | NA | NA | NA |
| 1924 | 3021 | TGGCAGAATCTGATGTTGGG | 2 | 1 | NC | NC | 76.53 | 27.81 | 6.51 | 4.41 | NA | NA | NA |
| 1925 | 3022 | GTGGCAGAATCTGATGTTGG | 2 | 2 | NC | NC | 77.58 | 69.65 | 6.65 | 4.52 | NA | NA | NA |
| 1927 | 3024 | GTGTGGCAGAATCTGATGTT | 2 | 2 | NC | NC | 83.41 | 99.90 | 7.50 | 4.41 | NA | NA | NA |
| 1945 | 3081 | TCTCTGTTGTATTGCTGTTA | 2 | 2 | NC | NC | 64.35 | 37.03 | 23.98 | 2.00 | NA | NA | NA |
| 1946 | 3082 | TTCTCTGTTGTATTGCTGTT | 2 | 2 | NC | NC | 64.62 | 23.18 | 11.74 | 2.00 | NA | NA | NA |
| 1947 | 3083 | GTTCTCTGTTGTATTGCTGT | 2 | 2 | NC | NC | 71.29 | 64.40 | 5.04 | 6.83 | NA | NA | NA |
| 1948 | 3084 | AGTTCTCTGTTGTATTGCTG | 2 | 1 | NC | NC | 79.95 | 65.34 | 5.20 | 4.98 | NA | NA | NA |
| 1949 | 3085 | CAGTTCTCTGTTGTATTGCT | 2 | 2 | NC | NC | 77.26 | 28.90 | 9.66 | 3.12 | NA | NA | NA |
| 1968 | 3114 | GCAATACCAAAGGAGTTTCT | 2 | 2 | NC | NC | 85.36 | 75.14 | 6.44 | 5.22 | NA | NA | NA |
| 2000 | 3162 | TGATAAGAACATCTGAATCT | 1 | 2 | 2 | 1 | 88.43 | 21.05 | 2.07 | 0.62 | NA | NA | NA |
| 2001 | 3163 | CTGATAAGAACATCTGAATC | 2 | 2 | 1 | 2 | 89.58 | 25.29 | 2.86 | 7.13 | NA | NA | NA |
| 2035 | 3217 | TTCATTAACATTCCACTGGG | 2 | 2 | NC | NC | 80.45 | 36.25 | 1.53 | 9.09 | NA | NA | NA |
| 2064 | 3247 | TTTTGGTCACCTGTGGCATC | 2 | 2 | NC | NC | 67.98 | 35.11 | 2.77 | 8.18 | NA | NA | NA |
| 2065 | 3248 | ATTTTGGTCACCTGTGGCAT | 2 | 2 | NC | NC | 69.79 | 51.93 | 3.01 | 3.52 | NA | NA | NA |
| 2066 | 3249 | CATTTTGGTCACCTGTGGCA | 2 | 2 | NC | NC | 76.12 | 28.42 | 5.63 | 2.67 | NA | NA | NA |
| 2067 | 3250 | CCATTTTGGTCACCTGTGGC | 2 | 3 | NC | NC | 68.04 | 33.46 | 20.39 | 2.51 | NA | NA | NA |
| 2090 | 3285 | CTCTTGCTTTAGATTCCTCA | 2 | 1 | NC | NC | 83.53 | 9.18 | 1.81 | 2.58 | NA | NA | NA |
| 2091 | 3286 | GCTCTTGCTTTAGATTCCTC | 2 | 2 | NC | NC | 71.84 | 47.28 | 4.04 | 12.13 | NA | NA | NA |
| 2163 | 3429 | AAGCAGCCTGAATGTCCTCA | 2 | 2 | NC | NC | 87.95 | 25.49 | 4.25 | 1.13 | NA | NA | NA |
| 2165 | 3431 | ACAAGCAGCCTGAATGTCCT | 2 | 2 | NC | NC | 99.44 | 110.40 | 3.74 | 5.44 | NA | NA | NA |
| 2166 | 3432 | TACAAGCAGCCTGAATGTCC | 2 | 1 | NC | NC | 97.23 | 31.29 | 6.00 | 0.83 | NA | NA | NA |
| 2167 | 3433 | GTACAAGCAGCCTGAATGTC | 2 | 2 | NC | NC | 90.96 | 76.47 | 4.29 | 17.69 | NA | NA | NA |
| 2168 | 3434 | AGTACAAGCAGCCTGAATGT | 2 | 2 | NC | NC | 102.95 | 74.55 | 23.06 | 9.33 | NA | NA | NA |
| 2169 | 3435 | TAGTACAAGCAGCCTGAATG | 3 | 2 | NC | NC | 93.15 | 26.83 | 2.25 | 2.87 | NA | NA | NA |

TABLE 3-continued

Positive ASOs

| SEQ ID NO | Position | Sequence | Off-target Score Human | Cyno | Mouse | Rat | mean % mRNA remaining 2 nM | 20 nM | SD % mRNA remaining 2 nM | 20 nM | IC20 (nM) | IC50 (nM) | IC80 (nM) |
|---|---|---|---|---|---|---|---|---|---|---|---|---|---|
| 2170 | 3436 | TTAGTACAAGCAGCCTGAAT | 2 | 2 | NC | NC | 83.07 | 20.20 | 4.86 | 2.24 | NA | NA | NA |
| 2171 | 3437 | TTTAGTACAAGCAGCCTGAA | 2 | 2 | NC | NC | 81.15 | 25.05 | 3.20 | 3.65 | NA | NA | NA |
| 2172 | 3438 | CTTTAGTACAAGCAGCCTGA | 2 | 3 | NC | NC | 75.61 | 30.14 | 1.47 | 2.07 | NA | NA | NA |
| 2173 | 3439 | TCTTTAGTACAAGCAGCCTG | 2 | 2 | NC | NC | 75.65 | 50.49 | 3.75 | 1.41 | NA | NA | NA |
| 2174 | 3440 | GTCTTTAGTACAAGCAGCCT | 2 | 2 | NC | NC | 83.92 | 81.72 | 2.88 | 2.28 | NA | NA | NA |
| 2175 | 3441 | GGTCTTTAGTACAAGCAGCC | 3 | 2 | NC | NC | 69.59 | 105.72 | 17.55 | 8.17 | NA | NA | NA |
| 2176 | 3442 | AGGTCTTTAGTACAAGCAGC | 3 | 2 | NC | NC | 82.11 | 68.72 | 3.70 | 3.29 | NA | NA | NA |
| 2178 | 3444 | TCAGGTCTTTAGTACAAGCA | 3 | 2 | NC | NC | 79.56 | 25.17 | 2.17 | 1.26 | NA | NA | NA |
| 2179 | 3445 | GTCAGGTCTTTAGTACAAGC | 2 | 2 | NC | NC | 75.74 | 78.33 | 4.46 | 3.66 | NA | NA | NA |
| 2181 | 3447 | TTGTCAGGTCTTTAGTACAA | 2 | 2 | NC | NC | 77.68 | 27.60 | 2.41 | 3.45 | NA | NA | NA |
| 2183 | 3449 | AGTTGTCAGGTCTTTAGTAC | 2 | 3 | NC | NC | 87.32 | 62.47 | 8.57 | 5.19 | NA | NA | NA |
| 2184 | 3450 | CAGTTGTCAGGTCTTTAGTA | 2 | 2 | NC | NC | 90.24 | 31.68 | 10.33 | 4.92 | NA | NA | NA |
| 2185 | 3451 | ACAGTTGTCAGGTCTTTAGT | 2 | 2 | NC | NC | 84.62 | 57.48 | 2.93 | 4.81 | NA | NA | NA |
| 2186 | 3452 | CACAGTTGTCAGGTCTTTAG | 2 | 2 | NC | NC | 81.04 | 24.63 | 3.98 | 1.43 | NA | NA | NA |
| 2188 | 3454 | GCCACAGTTGTCAGGTCTTT | 2 | 2 | NC | NC | 77.28 | 59.83 | 4.56 | 6.54 | NA | NA | NA |
| 2189 | 3455 | AGCCACAGTTGTCAGGTCTT | 2 | 2 | NC | NC | 80.32 | 54.89 | 1.38 | 5.77 | NA | NA | NA |
| 2194 | 3461 | ATCCACAGCCACAGTTGTCA | 2 | 1 | 1 | NC | 93.62 | 32.21 | 3.07 | 2.37 | NA | NA | NA |
| 2196 | 3463 | ACATCCACAGCCACAGTTGT | 2 | 2 | 1 | NC | 97.71 | 100.75 | 2.65 | 3.98 | NA | NA | NA |
| 2231 | 3517 | ACAAGGTCGCTTCTAAAAGG | 3 | 3 | NC | NC | 96.15 | 99.00 | 3.83 | 6.99 | NA | NA | NA |
| 2232 | 3518 | AACAAGGTCGCTTCTAAAAG | 2 | 2 | NC | NC | 96.10 | 50.39 | 6.27 | 3.96 | NA | NA | NA |
| 2255 | 3564 | GTCTCATCACAGTCCTCTCT | 2 | 2 | NC | NC | 69.15 | 21.87 | 4.29 | 1.53 | NA | NA | NA |
| 2256 | 3565 | TGTCTCATCACAGTCCTCTC | 2 | 2 | NC | NC | 74.55 | 12.10 | 3.74 | 3.37 | 0.51 | 1.60 | 6.81 |
| 2305 | 3643 | ACTGGATTGTCCCATTCTGA | 2 | 2 | NC | NC | 76.91 | 78.44 | 5.14 | 4.97 | NA | NA | NA |
| 2307 | 3645 | ATACTGGATTGTCCCATTCT | 2 | 2 | NC | NC | 83.27 | 18.42 | 4.00 | 3.26 | NA | NA | NA |
| 2308 | 3646 | AATACTGGATTGTCCCATTC | 2 | 2 | NC | NC | 89.74 | 54.56 | 3.68 | 2.13 | NA | NA | NA |
| 2312 | 3650 | GGCAAATACTGGATTGTCCC | 2 | 2 | NC | NC | 67.99 | 53.63 | 9.93 | 3.74 | NA | NA | NA |
| 2319 | 3658 | GGATAACGGGCAAATACTGG | 3 | 3 | NC | NC | 84.10 | 57.31 | 13.98 | 0.63 | NA | NA | NA |
| 2321 | 3660 | CTGGATAACGGGCAAATACT | 3 | 2 | NC | NC | 80.58 | 19.76 | 1.26 | 1.57 | NA | NA | NA |
| 2333 | 3685 | CCACTGCTTACATCAACAGC | 2 | 2 | NC | NC | 73.32 | 20.40 | 11.92 | 4.24 | NA | NA | NA |
| 2343 | 3718 | TTGTGAATTTTAACTGCTAA | 2 | 1 | NC | NC | 78.23 | 30.28 | 13.06 | 3.81 | NA | NA | NA |
| 2344 | 3719 | GTTGTGAATTTTAACTGCTA | 2 | 2 | NC | NC | 66.42 | 75.05 | 2.06 | 1.87 | NA | NA | NA |
| 2345 | 3720 | TGTTGTGAATTTTAACTGCT | 2 | 1 | NC | NC | 67.78 | 31.64 | 3.07 | 1.50 | NA | NA | NA |
| 2346 | 3721 | ATGTTGTGAATTTTAACTGC | 2 | 2 | NC | NC | 74.39 | 45.73 | 5.60 | 1.64 | NA | NA | NA |
| 2347 | 3722 | GATGTTGTGAATTTTAACTG | 2 | 2 | NC | NC | 69.84 | 80.44 | 3.44 | 4.12 | NA | NA | NA |
| 2348 | 3723 | AGATGTTGTGAATTTTAACT | 2 | 1 | NC | NC | 73.52 | 56.41 | 4.60 | 2.09 | NA | NA | NA |
| 2349 | 3724 | AAGATGTTGTGAATTTTAAC | 2 | 1 | NC | NC | 85.86 | 61.92 | 1.65 | 2.53 | NA | NA | NA |

TABLE 3-continued

Positive ASOs

| SEQ ID NO | Posi-tion | Sequence | Off-target Score Human | Cyno | Mouse | Rat | mean % mRNA remaining 2 nM | 20 nM | SD % mRNA remaining 2 nM | 20 nM | IC20 (nM) | IC50 (nM) | IC80 (nM) |
|---|---|---|---|---|---|---|---|---|---|---|---|---|---|
| 2353 | 3745 | TTGGTGAAAC GATAGGGATA | 3 | 2 | NC | NC | 86.80 | 31.94 | 2.61 | 2.18 | NA | NA | NA |
| 2354 | 3746 | TTTGGTGAAA CGATAGGGAT | 3 | 2 | NC | NC | 87.43 | 48.40 | 2.51 | 2.09 | NA | NA | NA |
| 2355 | 3747 | CTTTGGTGAA ACGATAGGGA | 3 | 2 | NC | NC | 79.57 | 41.96 | 2.83 | 9.43 | NA | NA | NA |
| 2394 | 3807 | TCAAACAGGC AATAAACTTG | 2 | 2 | NC | NC | 85.98 | 17.77 | 3.56 | 0.98 | NA | NA | NA |
| 2395 | 3808 | ATCAAACAGG CAATAAACTT | 2 | 2 | NC | NC | 77.20 | 34.29 | 3.93 | 5.96 | NA | NA | NA |
| 2402 | 3815 | AGTGCTCATC AAACAGGCAA | 2 | 2 | NC | NC | 71.00 | 59.57 | 3.50 | 2.67 | NA | NA | NA |
| 2403 | 3816 | TAGTGCTCAT CAAACAGGCA | 2 | 3 | NC | NC | 73.32 | 22.08 | 4.57 | 1.81 | NA | NA | NA |
| 2404 | 3817 | TTAGTGCTCAT CAAACAGGC | 2 | 3 | NC | NC | 67.42 | 18.47 | 3.66 | 3.11 | 0.11 | 0.52 | 4.24 |
| 2460 | 3953 | TTTCCGACCA GAGCCTTGTG | 2 | 3 | NC | NC | 68.68 | 26.50 | 3.08 | 2.92 | NA | NA | NA |
| 2461 | 3954 | TTTTCCGACC AGAGCCTTGT | 2 | 3 | NC | NC | 72.55 | 21.26 | 8.32 | 1.45 | NA | NA | NA |
| 2462 | 3955 | TTTTTCCGACC AGAGCCTTG | 2 | 2 | NC | NC | 80.37 | 21.01 | 7.60 | 0.85 | NA | NA | NA |
| 2489 | 4007 | TTCCTCTGTCA CTGTTATCT | 2 | 2 | NC | NC | 70.56 | 20.33 | 4.00 | 2.58 | NA | NA | NA |
| 2490 | 4008 | GTTCCTCTGT CACTGTTATC | 2 | 2 | NC | NC | 57.22 | 45.09 | 3.16 | 4.14 | NA | NA | NA |
| 2491 | 4009 | TGTTCCTCTGT CACTGTTAT | 2 | 2 | NC | NC | 46.82 | 19.73 | 5.54 | 1.38 | 0.81 | 2.08 | 8.70 |
| 2492 | 4010 | TTGTTCCTCTG TCACTGTTA | 2 | 2 | NC | NC | 80.76 | 17.70 | 5.97 | 2.11 | NA | NA | NA |
| 2495 | 4013 | CCTTTGTTCCT CTGTCACTG | 2 | 2 | NC | NC | 76.11 | 27.57 | 3.18 | 1.96 | NA | NA | NA |
| 2499 | 4017 | GTCTCCTTTGT TCCTCTGTC | 2 | 1 | NC | NC | 74.25 | 27.62 | 5.34 | 2.50 | NA | NA | NA |
| 2500 | 4018 | AGTCTCCTTT GTTCCTCTGT | 2 | 2 | NC | NC | 77.94 | 41.70 | 4.52 | 3.15 | NA | NA | NA |
| 2524 | 4055 | GCCCAGATCT TCCAGATTTT | 2 | 2 | NC | NC | 76.59 | 23.44 | 6.97 | 5.81 | NA | NA | NA |
| 2525 | 4056 | GGCCCAGATC TTCCAGATTT | 2 | 3 | NC | NC | 79.60 | 24.75 | 7.75 | 4.87 | NA | NA | NA |
| 2526 | 4057 | AGGCCCAGAT CTTCCAGATT | 2 | 2 | NC | NC | 87.17 | 42.54 | 6.66 | 2.40 | NA | NA | NA |
| 2527 | 4058 | AAGGCCCAGA TCTTCCAGAT | 2 | 1 | NC | NC | 74.99 | 24.17 | 4.99 | 1.25 | NA | NA | NA |
| 2528 | 4059 | CAAGGCCCAG ATCTTCCAGA | 2 | 2 | NC | NC | 69.53 | 12.61 | 6.77 | 1.96 | 0.19 | 0.78 | 3.63 |
| 2529 | 4060 | TCAAGGCCCA GATCTTCCAG | 2 | 2 | NC | NC | 79.06 | 11.16 | 6.66 | 1.99 | NA | NA | NA |
| 2530 | 4061 | TTCAAGGCCC AGATCTTCCA | 2 | 2 | NC | NC | 71.09 | 10.79 | 15.83 | 1.14 | 0.67 | 2.40 | 8.30 |
| 2561 | 4092 | CCAGAGAATC ACTAGTGTCT | 2 | 2 | NC | NC | 75.02 | 18.73 | 1.75 | 3.89 | NA | NA | NA |
| 2562 | 4093 | ACCAGAGAAT CACTAGTGTC | 2 | 2 | NC | NC | 83.46 | 32.29 | 4.66 | 2.17 | NA | NA | NA |
| 2591 | 4142 | TTCATTGGCTT CTCTTTCCA | 2 | 1 | NC | NC | 100.38 | 16.31 | 8.53 | 1.96 | NA | NA | NA |
| 2595 | 4146 | GAAGTTCATT GGCTTCTCTT | 2 | 2 | NC | NC | 80.58 | 38.80 | 10.34 | 1.73 | NA | NA | NA |
| 2616 | 4177 | ATACTCTTGGT CACAGTAGA | 2 | 2 | NC | NC | 106.26 | 20.10 | 17.09 | 2.60 | NA | NA | NA |
| 2644 | 4244 | CAATGTCCCT TGGATGCCTC | 2 | 2 | NC | NC | 77.84 | 12.14 | 15.18 | 0.55 | NA | NA | NA |
| 2645 | 4245 | GCAATGTCCC TTGGATGCCT | 2 | 2 | NC | NC | 60.68 | 31.07 | 16.38 | 3.72 | NA | NA | NA |
| 2646 | 4247 | TGGCAATGTC CCTTGGATGC | 2 | 2 | NC | NC | 70.78 | 15.47 | 2.39 | 2.28 | 0.07 | 0.30 | 1.71 |
| 2647 | 4248 | GTGGCAATGT CCCTTGGATG | 2 | 1 | NC | NC | 69.26 | 31.74 | 1.13 | 3.38 | NA | NA | NA |
| 2648 | 4249 | AGTGGCAATG TCCCTTGGAT | 3 | 2 | NC | NC | 90.27 | 38.94 | 11.22 | 2.21 | NA | NA | NA |
| 2649 | 4250 | CAGTGGCAAT GTCCCTTGGA | 2 | 1 | NC | NC | 77.65 | 23.04 | 6.54 | 2.25 | NA | NA | NA |

TABLE 3-continued

| Positive ASOs | | | | | | | | | | | | | |
|---|---|---|---|---|---|---|---|---|---|---|---|---|---|
| SEQ ID NO | Position | Sequence | Off-target Score | | | | mean % mRNA remaining | | SD % mRNA remaining | | IC20 | IC50 | IC80 |
| | | | Human | Cyno | Mouse | Rat | 2 nM | 20 nM | 2 nM | 20 nM | (nM) | (nM) | (nM) |
| 2650 | 4251 | TCAGTGGCAA TGTCCCTTGG | 2 | 2 | NC | NC | 85.94 | 20.36 | 8.42 | 1.96 | NA | NA | NA |
| 2651 | 4252 | GTCAGTGGCA ATGTCCCTTG | 2 | 2 | NC | NC | 85.16 | 27.43 | 7.37 | 2.02 | NA | NA | NA |
| 2653 | 4254 | CAGTCAGTGG CAATGTCCCT | 2 | 2 | NC | NC | 93.15 | 17.75 | 10.65 | 4.43 | NA | NA | NA |
| 2654 | 4255 | ACAGTCAGTG GCAATGTCCC | 2 | 2 | NC | NC | 96.92 | 27.17 | 5.79 | 3.70 | NA | NA | NA |
| 2661 | 4262 | CTTCTGGACA GTCAGTGGCA | 2 | 2 | 2 | NC | 88.73 | 25.80 | 4.68 | 2.02 | NA | NA | NA |
| 2662 | 4264 | ACCTTCTGGA CAGTCAGTGG | 2 | 3 | 2 | NC | 80.03 | 24.32 | 11.32 | 1.04 | NA | NA | NA |
| 2663 | 4265 | CACCTTCTGG ACAGTCAGTG | 2 | 2 | 1 | NC | 84.78 | 19.26 | 5.85 | 0.82 | NA | NA | NA |
| 2664 | 4266 | ACACCTTCTG GACAGTCAGT | 2 | 2 | 2 | NC | 88.41 | 20.19 | 9.00 | 1.26 | NA | NA | NA |
| 2666 | 4270 | GCCAACACCT TCTGGACAGT | 2 | 3 | 2 | 2 | 70.57 | 59.95 | 5.04 | 11.62 | NA | NA | NA |
| 2674 | 4279 | GCTTGGGATG CCAACACCTT | 2 | 2 | NC | NC | 60.17 | 36.14 | 1.75 | 4.07 | NA | NA | NA |
| 2683 | 4331 | GCAACTTTCC TGTAAGCTCA | 2 | 1 | NC | NC | 73.18 | 40.51 | 1.94 | 4.45 | NA | NA | NA |
| 2684 | 4332 | GGCAACTTTC CTGTAAGCTC | 2 | 2 | NC | NC | 73.71 | 24.96 | 1.41 | 4.04 | NA | NA | NA |
| 2685 | 4333 | CGGCAACTTT CCTGTAAGCT | 2 | 2 | NC | NC | 72.28 | 42.00 | 3.03 | 4.43 | NA | NA | NA |
| 2686 | 4334 | GCGGCAACTT TCCTGTAAGC | 2 | 2 | NC | NC | 73.11 | 53.99 | 4.51 | 5.22 | NA | NA | NA |
| 2687 | 4335 | GGCGGCAACT TTCCTGTAAG | 2 | 3 | NC | NC | 71.34 | 43.45 | 2.25 | 2.01 | NA | NA | NA |
| 2688 | 4336 | AGGCGGCAAC TTTCCTGTAA | 2 | 3 | NC | NC | 69.70 | 64.52 | 3.46 | 4.27 | NA | NA | NA |
| 2689 | 4337 | AAGGCGGCAA CTTTCCTGTA | 2 | 3 | NC | NC | 71.47 | 58.98 | 2.65 | 5.60 | NA | NA | NA |
| 2690 | 4338 | TAAGGCGGCA ACTTTCCTGT | 3 | 2 | NC | NC | 74.69 | 43.99 | 7.35 | 10.52 | NA | NA | NA |
| 2691 | 4339 | ATAAGGCGGC AACTTTCCTG | 3 | 3 | NC | NC | 78.56 | 42.65 | 5.65 | 5.21 | NA | NA | NA |
| 2692 | 4340 | AATAAGGCGG CAACTTTCCT | 2 | 2 | NC | NC | 89.94 | 64.68 | 2.17 | 4.62 | NA | NA | NA |
| 2693 | 4341 | CAATAAGGCG GCAACTTTCC | 2 | 2 | NC | NC | 94.34 | 21.32 | 2.79 | 0.66 | NA | NA | NA |
| 2694 | 4342 | TCAATAAGGC GGCAACTTTC | 2 | 2 | NC | NC | 90.44 | 18.79 | 5.41 | 2.47 | NA | NA | NA |
| 2695 | 4343 | TTCAATAAGG CGGCAACTTT | 2 | 2 | NC | NC | 96.91 | 21.42 | 6.53 | 3.19 | NA | NA | NA |
| 2725 | 4423 | AAGTGGTCTA TGTCAGCTAA | 2 | 3 | NC | NC | 103.47 | 34.92 | 18.44 | 5.10 | NA | NA | NA |
| 2726 | 4424 | CAAGTGGTCT ATGTCAGCTA | 3 | 3 | NC | NC | 89.60 | 27.45 | 11.00 | 6.09 | NA | NA | NA |
| 2727 | 4425 | CCAAGTGGTC TATGTCAGCT | 2 | 2 | NC | NC | 81.51 | 20.32 | 8.29 | 3.05 | NA | NA | NA |
| 2728 | 4426 | TCCAAGTGGT CTATGTCAGC | 2 | 2 | NC | NC | 92.66 | 17.90 | 18.04 | 1.23 | NA | NA | NA |
| 2777 | 4475 | GGCCATTTTG CGAAGTTTAG | 2 | 2 | NC | NC | 78.11 | 21.08 | 3.67 | 2.43 | NA | NA | NA |
| 2778 | 4476 | GGGCCATTTT GCGAAGTTTA | 3 | 3 | NC | NC | 73.18 | 17.87 | 4.11 | 1.66 | NA | NA | NA |
| 2779 | 4477 | TGGGCCATTT TGCGAAGTTT | 2 | 3 | NC | NC | 76.21 | 21.60 | 5.41 | 3.30 | NA | NA | NA |
| 2780 | 4478 | CTGGGCCATT TTGCGAAGTT | 2 | 3 | NC | NC | 78.35 | 23.66 | 5.34 | 2.29 | NA | NA | NA |
| 2781 | 4479 | CCTGGGCCAT TTTGCGAAGT | 2 | 3 | NC | NC | 77.45 | 30.09 | 4.91 | 2.39 | NA | NA | NA |
| 2782 | 4498 | TTTCCAAAGA GACGCCAGGC | 2 | 2 | NC | NC | 84.94 | 25.18 | 4.09 | 2.62 | NA | NA | NA |
| 2784 | 4500 | CTTTTCCAAAG AGACGCCAG | 2 | 2 | NC | NC | 88.49 | 23.15 | 2.79 | 2.49 | NA | NA | NA |
| 2785 | 4501 | GCTTTTCCAAA GAGACGCCA | 2 | 2 | NC | NC | 82.32 | 26.63 | 4.10 | 2.04 | NA | NA | NA |
| 2789 | 4505 | CTCTGCTTTTC CAAAGAGAC | 2 | 2 | NC | NC | 83.50 | 37.28 | 7.11 | 8.40 | NA | NA | NA |

TABLE 3-continued

| Positive ASOs | | | | | | | | | | | | | |
|---|---|---|---|---|---|---|---|---|---|---|---|---|---|
| SEQ ID NO | Position | Sequence | Off-target Score Human | Cyno | Mouse | Rat | mean % mRNA remaining 2 nM | 20 nM | SD % mRNA remaining 2 nM | 20 nM | IC20 (nM) | IC50 (nM) | IC80 (nM) |
| 2791 | 4508 | ACACTCTGCT TTTCCAAAGA | 2 | 2 | NC | NC | 73.84 | 20.07 | 19.34 | 2.81 | NA | NA | NA |
| 2792 | 4509 | CACACTCTGC TTTTCCAAAG | 2 | 2 | NC | NC | 79.18 | 14.66 | 2.80 | 0.76 | NA | NA | NA |
| 2794 | 4511 | ATCACACTCT GCTTTTCCAA | 2 | 1 | NC | NC | 78.29 | 17.01 | 3.86 | 3.71 | NA | NA | NA |
| 2795 | 4512 | TATCACACTCT GCTTTTCCA | 2 | 2 | NC | NC | 93.31 | 19.05 | 0.79 | 2.98 | NA | NA | NA |
| 2797 | 4514 | TGTATCACACT CTGCTTTTC | 2 | 2 | NC | NC | 97.20 | 16.90 | 2.92 | 0.94 | NA | NA | NA |
| 2848 | 4672 | AGGGACACTG GGCTGATTCA | 2 | 2 | NC | NC | 94.48 | 45.86 | 2.48 | 0.73 | NA | NA | NA |
| 2849 | 4683 | CTAAGCTGCT CAGGGACACT | 2 | 2 | NC | NC | 81.53 | 19.47 | 9.03 | 2.11 | NA | NA | NA |
| 2850 | 4684 | TCTAAGCTGC TCAGGGACAC | 2 | 2 | NC | NC | 81.17 | 21.06 | 7.52 | 1.31 | NA | NA | NA |
| 2851 | 4685 | GTCTAAGCTG CTCAGGGACA | 2 | 1 | NC | NC | 76.71 | 30.35 | 7.66 | 6.99 | NA | NA | NA |
| 2852 | 4686 | TGTCTAAGCT GCTCAGGGAC | 2 | 2 | NC | NC | 87.76 | 29.98 | 8.64 | 2.25 | NA | NA | NA |
| 2917 | 4787 | CATGGATGCA AATGAATGAA | 2 | 2 | NC | NC | 80.58 | 21.83 | 5.14 | 6.54 | NA | NA | NA |
| 2918 | 4788 | CCATGGATGC AAATGAATGA | 2 | 2 | NC | NC | 73.11 | 25.80 | 8.72 | 2.66 | NA | NA | NA |

Example 3. In Vitro Screen for Reduced Expansion

Expansion of DNA triplet repeats can be replicated in vitro using patient-derived cells lines and DNA-damaging agents Human fibroblasts from Huntington's (GM04281, GM04687 and GM04212) or Friedreich's Ataxia patients (GM03816 and GM02153) or Myotonic Dystrophyl (GM04602, GM03987 and GM03989) are purchased from Coriell Cell Repositories and are maintained in medium following the manufacturer's instructions (Kovtum et al., 2007 Nature, 447(7143). 447-452; Li et al., 2016 Biopreservation and Btobanking 14(4):324-29; Zhang et al., 2013 Mol Ther 22(2): 312-320). To induce CAG-repeat expansion in vitro, fibroblast cells are treated with oxidizing agents such as hydrogen peroxide (H2O2) potassium chromate (K2CrO4) or potassium bromate (KBrOa) for up to 2 hrs (Kovtum et al., ibid). Cells are washed, and medium replace to allow cells to recover for 3 days. The treatment is repeated up to twice more before cells are harvested and DNA isolated. CAG repeat length is determined using methods described below.

Expansion of DNA triplet repeats can be replicated in vitro using patient-derived cell lines. Induced pluripotent stem cells (iPSC) derived from Human fibroblasts from Huntington's Patients (CSO9iHD-109n1) are purchased from Cedars-Sinai RMI Induced Pluripotent Stem Cell Core and are maintained following the manufacturer's recommendations (httos://www cedars-sinai.org/content/dam/cedars-sinai/research/documents/biomanufacturina/recommended-guidelines-for-handlina-ioscsvl.Ddf). The CAG repeat from an iPSC line with 109 CAGs shows an increase in CAG repeat size overtime, with an average expansion of 4 CAG repeats over 70 days in dividing iPS cells (Goold et al., 2019 Human Molecular Genetics February 15, 28(4): 650-661).

CSO9iHD-109n1 iPSC are treated with ASO for continuous knockdown of target mRNA and CAG repeat expansion is determined by DNA fragment analysis described below. ASOs are added to cells in varying concentrations every 3 to 15 days and knockdown of mRNA is determined by RT-qPCR using standard molecular biology techniques. DNA and mRNA are isolated from cells according to standard techniques at t=0.14 days, 28 days, 42 days, 56 days and 80 days. The differences in expansion between treatment and control are compared according to a linear repeated-measures model, and at each time point according to Tukey's post-hoc tests.

Example 4

Genomic DNA Extraction and Quantitation of CAG Repeat Length by Small Pool-PCR (sp-PCR) Analyses Genomic DNA is purified using standard Proteinase K digestions and extracted using DNAzol (Invitrogen) following the manufacturer's instructions. CAG repeat length is determined by small pool-PCR analyses as previously described (Mario Gomes-Pereira and Darren Monckton, 2017, Front Cell Neuro 11:153). In brief, DNA is digested with Hindlll, diluted to a final concentration between 1-6 pg/μl and approximately 10 μg was used in subsequent PCR reactions. Primer flaking Exon 1 of the human HTT are used to amplify the CAG alleles and the PCR product is resolved by electrophoresis. Subsequently, Southern blot hybridization is performed, and the CAG alleles are observed by autoradiography OR visualized with ethidium bromide staining. CAG length can be measured directly by sequencing on a MiSeQ or appropriate machine. The change in CAG repeat number in various treatment groups in comparison with controls is calculated using simple descriptive statistics (e.g. mean±standard deviation).

Genomic DNA Extraction and Quantitation of CAG Repeat Length by DNA Fragment Analyses Genomic DNA is purified using DNAeasy Blood and Tissue Kit (Qiagen) following the manufacturers instructions. DNA is quantified by Qubit dsDNA assay (Themo- Scientific) and CAG repeat length is determined by fragment analysis by Laragen (Culver City, CA)

Example 5. Mouse Studies

Natural History Studies in HD Mouse Models:

The HD mouse R6/2 line is transgenic for the 5' end of the human HD gene (HTT) carrying approximately 120 CAG repeat expansions. HTT is ubiquitously expressed. Transgenic mice exhibit a progressive neurological phenotype that mimics many of the pathological features of HD, including choreiform-like movements, involuntary stereotypic movements, tremor, and epileptic seizures, as well as nonmovement disorder components, including unusual vocalization. They urinate frequently and exhibit loss of body weight and muscle bulk through the course of the disease Neurologically these mice develop Neuronal Intranuclear Inclusions (Nil) which contain both the huntingtin and ubiquitin proteins. Previously unknown, these NIl have subsequently been identified in HD patients. The age of onset for development of HD symptoms in R6/2 mice has been reported to occur between 9 and 11 weeks (Mangiarini et al., 1996 Cell 87: 493-506).

Figure 2:
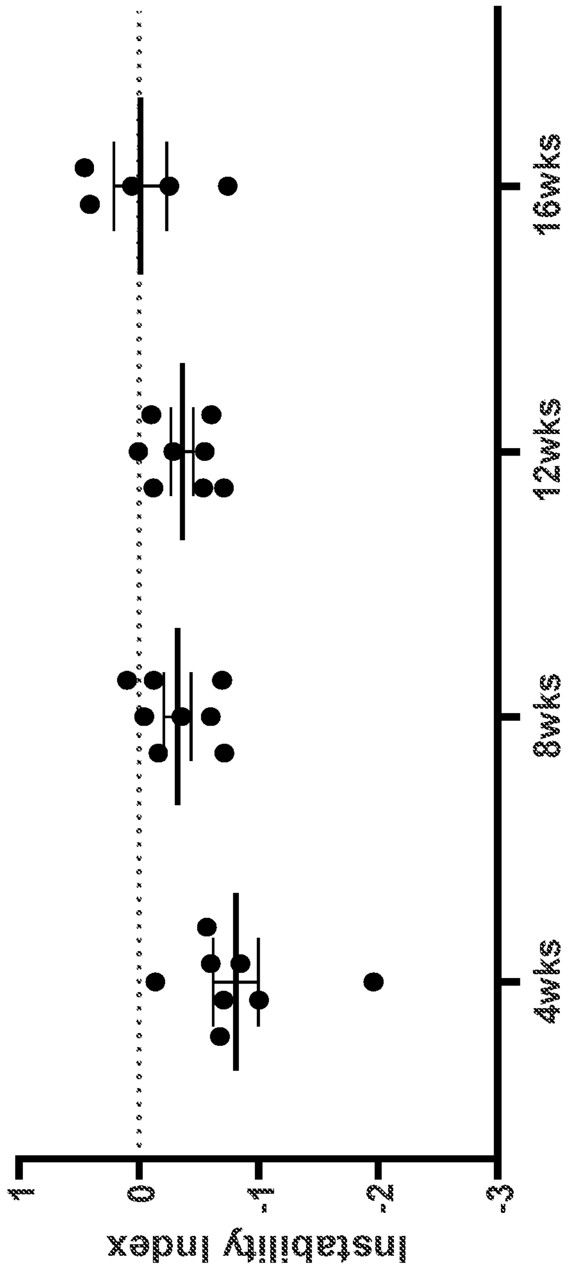
FIG. 2 is a distribution plot showing the somatic expansion of a human HTT transgene in the cerebellum as measured by the instability index in R6/2 mice at 4, 8, 12, and 16 weeks of age (4 male and 4 female per age group).

Somatic expansions were reported in R6/2 mice striatum, cortex and liver. Somatic instability increased with higher constitutive length (Larson et al, Neurobiology of Disease 76 (2015) 98-111). A natural history study in R6/2 mice with 120 CAG repeats was performed. Their genotype and length of CAG expansion was determined. R6/2 mice at 4, 8, 12 and 16 weeks of age (4 male and 4 female mice per age group) were sacrificed. Striatum, cerebellum, cortex, liver, kidney, heart, spleen, lung, duodenum, colon, quadricep, CSF and plasma were collected and snap frozen in liquid nitrogen. Genomic DNA was extracted, the length of CAG repeats measured, and the instability index was calculated from striatum, cerebellum, cortex, liver and kidney according to Lee et al. BMC Systems Biology 2010, 4:29). At 12 and 16 weeks of age, the striatum showed a significant increase of somatic expansion as measured by the instability index (**$p<0.0001$, One-way ANOVA) (FIG. 1). No changes in somatic expansion were observed across all ages in the R6/2 mouse cerebellum (FIG. 2**).

Mouse models recapitulating many of the features of trinucleotide repeat expansion diseases including, HD, FA and DM1, are readily available from commercial venders and academic institutions (Polyglutamine Disorders, Advances in Experimental Medicine and Biology, Vol 1049, 2018: Editors Clevio Nobrega and Lois Pereira de Almeida, Springer). All mouse experiments are conducted in accordance with local IACUC guidelines. Three examples of different diseased mouse models and how they could be used to investigate the usefulness of pharmacological intervention against MLH3 for somatic expansion are included below.

In Huntington's research, several transgenic and knock-in mouse models were generated to investigate the underlying pathological mechanisms involved in the disease. For example, the R6/2 transgenic mouse contains a transgene of ~1.9 kb of human HTT containing 144 copies of the CAG repeat (Mangiarini et al., 1996 Cell 87: 493-506) while the HdhQ111 model was generated by replacing the mouse HTT exon 1 with a human exon1 containing 111 copies of the CAG repeat (Wheeler et al., 2000 *Hum Mol Genet* 9:503-513). Both the R6/2 and HdhQ111 models replicate many of the features of human HD including motor and behavioral dysfunctions, neuronal loss, as well as the expansion of CAG repeats in the striatum (Pouladi et al., 2013, *Nature Reviews Neuroscience* 14: 708-721; Mangiarini et al., 1997 *Nature Genet* 15: 197-200; Wheeler et al., *Hum Mol Genet* 8: 115-122).

R6/2 mice are genotyped using DNA derived from tail snips at weaning and the CAG repeat size is determined. Mice are randomized into groups (n=12/group) at weaning at 4 wks old and dosed with monthly (week 4 and 8) ICV injection of either PBS (control) or up to a 500 μg dose of oligos targeting MLH3. A series of oligos targeting different regions of MLH3 can be tested to identify the most efficacious oligo sequence in vivo. At 12 weeks of age, mice are euthanized, and tissues extracted for analyses. The list of tissues includes, but not restricted to, striatum, cortex, cerebellum, and liver. Genomic DNA is extracted and the length of CAG repeats measured as described below. CSF and plasma are collected for biomarker analysis. Additional pertinent mouse models of HD can be considered.

In Friedreich Ataxia, the YG8 FRDA transgenic mouse model is commonly used to understand the pathology (Al-Mahdawi et al., 2006 Genomics 88(5)580-590; Bourn et al., 2012 PLOS One 7(10); e47085). This model was generated through the insertion of a human YAC transgenic containing in the background of a null FRDA mouse. The YG8 model demonstrates somatic expansion of the GAA triplet repeat expansion in neuronal tissues with only mild motor defects. YG8 FRDA mice are genotyped using DNA derived from tail snips at weaning and the CAG repeat size is determined using methods. To determine if MLH3 μlays a role in somatic expansion of the disease allele, hemizygous YG8 FRDA animals are administered ICV with oligos targeting knockdown of MLH3 identified above.

Approximately 2 months later, animals are euthanized and tissues collected for molecular analyses. Suitable tissues are heart, quadriceps, dorsal root ganglia (DRG's), cerebellum, kidney, and liver. Genomic DNA is extracted, and the length of CAG repeats measured as described above in Example 4.

In Myotonic Dystrophy, the DM300-328 transgenic mouse model is suitable for investigating the pathology behind DM1. This mouse model has a large human genomic sequence (~45 kb) containing over 300 CTG repeats and displays both the somatic expansion and degenerative muscle changes observed in human DM1 (Seznec et al., 2000; Tome et al., 2009 PLOS Genetics 5(5): e1000482; Pandey et al., 2015 *J Pharmacol Exp Ther* 355:329-340). DM300-328 mice are genotyped using DNA derived from tail snips at weaning and the CAG repeat size is determined. To determine if MLH3 μlays a role in somatic expansion of the disease allele in myotonic dystrophy, DM300-328 transgenic animals are administered ASOs targeting knockdown of MLH3 by either subcutaneous injections (sc), intraperitoneal (ip) or intravenous tail injections (iv). Mice are administered ASOs up to 2×/week for maximum 8 weeks of treatment. Animals are euthanized at multiple time points and tissues collected for molecular analyses. Suitable tissues are quadriceps, heart, diaphragm, cortex, cerebellum, sperm, kidney, and liver. Genomic DNA is extracted and the length of CAG repeats measured and compared with parallel controls.

The $Hdh^{Q111}$ mouse model for Huntington Disease is a heterozygous knock-in line, in which the majority of exon 1 and part of intron 1 on one allele of the huntingtin gene (i.e., HTT or Huntington Disease gene) are replaced with human DNA containing ~111 CAG repeats. In this example, ASOs to knock down MLH3 activity or levels is administered. After a treatment period, brain tissue from treated or untreated mice is isolated (e.g., striatum tissue) and analyzed using qRT-PCR as previously described to determine RNA levels of MLH3. Huntingtin gene repeat analysis is performed using mouse tissues (e.g., striatum tissue) after a treatment period using a human-specific PCR assay that amplifies the HTT CAG repeat from the knock-in allele but does not amplify the mouse sequence (i e., the wild type allele). In this protocol, the forward primer is fluorescently labeled (e.g., with 6-FAM as described previously, for example Pinto RM, Dragileva E, Kirby A, et al. Mismatch repair genes MLH1 and MLH3 modify CAG instability in Huntington's disease mice: genome-wide and candidate approaches. PLoS Genet. 2013; 9(10):e1003930.), and products can be resolved using an analyzer with comparison against an internal size standard to generate CAG repeat size distribution traces. Repeat size is determined from the peak with the greatest intensity from a control tissue (e.g., tail tissue in a mouse) and from an affected tissue (e.g., brain striatum tissue or brain cortex tissue). Immunohistochemistry is carried out with polyclonal anti-huntingtin antibody (e.g., EM48) on paraffin-embedded or otherwise prepared sections of brain tissue and can be quantified using a standardized staining index to capture both nuclear staining intensity and number of stained nuclei. A decrease in repeat size in affected tissue indicates that the agent that reduces the level and/or activity of MLH3 is capable of decreasing the repeat which are responsible for the toxic and/or defective gene products in Huntington's disease.

Other Aspects

All publications, patents, and patent applications mentioned in this specification are incorporated herein by reference in their entirety to the same extent as if each individual publication, patent, or patent application was specifically and individually indicated to be incorporated by reference in its entirety. Where a term in the present application is found to be defined differently in a document incorporated herein by reference, the definition provided herein is to serve as the definition for the term.

While the invention has been described in connection with specific aspects thereof, it will be understood that invention is capable of further modifications and this application is intended to cover any variations, uses, or adaptations of the invention following, in general, the principles of the invention and including such departures from the present disclosure that come within known or customary practice within the art to which the invention pertains and can be applied to the essential features hereinbefore set forth, and follows in the scope of the claimed.

In addition to the various aspects described herein, the present disclosure includes the following aspects numbered E1 through E90. This list of aspects is presented as an exemplary list and the application is not limited to these aspects.

E1. A single-stranded oligonucleotide of 10-30 linked nucleosides in length, wherein the oligonucleotide comprises a region of at least 10 contiguous nucleobases having at least 80% complementarity to an MLH3 gene.

E2. The oligonucleotide of E1, wherein the oligonucleotide comprises: (a) a DNA core sequence comprising linked deoxyribonucleosides, (b) a 5' flanking sequence comprising linked nucleosides; and (c) a 3' flanking sequence comprising linked nucleosides; wherein the DNA core comprises a region of at least 10 contiguous nucleobases having at least 80% complementarity to an MLH3 gene and is positioned between the 5' flanking sequence and the 3'flanking sequence; wherein the 5' flanking sequence and the 3' flanking sequence each comprises at least two linked nucleosides; and wherein at least one nucleoside of each flanking sequence comprises an alternative nucleoside.

E3. A single-stranded oligonucleotide of 10-30 linked nucleosides in length for inhibiting expression of a human MLH3 gene in a cell, wherein the oligonucleotide comprises a region of at least 10 contiguous nucleobases having at least 80% complementarity to an MLH3 gene E4. The oligonucleotide of E3, wherein the oligonucleotide comprises: (a) a DNA core comprising linked deoxyribonucleosides; (b) a 5' flanking sequence comprising linked nucleosides; and (c) a 3' flanking sequence comprising linked nucleosides; wherein the DNA core comprises a region of at least 10 contiguous nucleobases having at least 80% complementarity to an MLH3 gene and is positioned between the 5' flanking sequence and the 3' flanking sequence, wherein the 5' flanking sequence and the 3' flanking sequence each comprises at least two linked nucleosides; and wherein at least one nucleoside of each flanking sequence comprises an alternative nucleoside.

E5. The oligonucleotide of any one of E1-E4, wherein the region of at least 10 nucleobases has at least 90% complementary to an MLH3 gene.

E6. The oligonucleotide of any one of E1-E5, wherein the region of at least 10 nucleobases has at least 95% complementary to an MLH3 gene.

E7. The oligonucleotide of any one of E1-E6, wherein the region of at least 10 nucleobases is complementary to an MLH3 gene corresponding to a sequence of reference mRNA NM_001040108.1 at one or more of positions 221-293, 321-506, 534-576, 584-636, 681-740, 818-878, 952-1024, 1129-1158, 1177-1264, 1287-1318, 1351-1378, 1536-1598, 1623-1660, 1739-1764, 1782-1823, 1847-1908, 2026-2051, 2063-2094, 2115-2146, 2256-2290, 2387-2414, 2421-2592, 2727-2788, 2826-2937, 3005-3043, 3078-3107, 3159-3185, 3214-3239, 3244-3272, 3282-3308, 3426-3483, 3561-3587, 3642-3769, 3804-3839, 3950-3977, 4004-4040, 4052-4115, 4139-4199, 4241-4301, 4328-4365, 4420-4448, 4472-4536, 4669-4708, or 4784-4810 of the MLH3 gene E8. The oligonucleotide of any one of E1-E6, wherein the region of at least 10 nucleobases is complementary to an MLH3 gene corresponding to a sequence of reference mRNA NM_001040108.1 at one or more of positions 221-293, 321-506, 534-576, 584-636, 681-740, 818-878, 952-1024, 1129-1158, 1177-1264, 1287-1318, 1351-1378, 1568-1598, 1623-1660, 1782-1823, 1870-1904, 2063-2094, 2115-2146, 2256-2287, 2387-2414, 2422-2592, 2727-2788, 2826-2937, 3009-3043, 3078-3107, 3159-3185, 3214-3272, 3282-3307, 3426-3483, 3561-3587, 3642-3767, 3804-3839, 3950-3977, 4004-4039, 4052-4115, 4139-4199, 4241-4301, 4329-4365, 4420-4448, 4472-4536, 4680-4708, or 4784-4810 of the MLH3 gene.

E9. The oligonucleotide of any one of E1-E6, wherein the region of at least 10 nucleobases is complementary to an MLH3 gene corresponding to a sequence of reference mRNA NM_001040108.1 at one or more of positions 221-293, 321-506, 534-635, 681-740, 842-875, 953-1024, 1129-1158, 1179-1264, 1287-1316, 1351-1378, 1568-1598, 1623-1659, 1782-1823, 1870-1904, 2064-2091, 2115-2146, 2256-2287, 2387-2414, 2422-2592, 2727-2788,2829-2937, 3010-3043, 3079-3107, 3159-3185, 3246-3271, 3282-3307, 3426-3474, 3561-3587, 3642-3707, 3804-3839, 3950-3977, 4004-4039, 4052-4114, 4139-4164, 4174-4199, 4241-4288, 4329-4365, 4421-4448, 4472-4536, 4680-4708, or 4784-4810 of the MLH3 gene.

E10. The oligonucleotide of any one of E1-E6, wherein the region of at least 10 nucleobases is complementary to an MLH3 gene corresponding to a sequence of reference mRNA NM_001040108.1 at one or more of positions 331-362, 393-438, 479-505, 534-574, 587-612, 681-740, 847-873, 991-1024, 1210-1262, 1351-1378, 1571-1597, 1623-1648, 1874-1902, 2066-2091, 2256-2281, 2388-2414, 2470-2515, 2732-2788, 2853-2878, 2901-2927, 3282-3307, 3562-3587, 4056-4083, 42414266, or 4506-4531 of the MLH3 gene.

E11. The oligonucleotide of any one of E1-E6, wherein the region of at least 10 nucleobases is complementary to an MLH3 gene corresponding to a sequence of reference mRNA NM_001040108.1 at one or more of positions 335-449, 587-612, 682-736, 848-873, 991-1016, 1179-1204, 1233-1260, 1351-1378, 1626-1651, 1874-1903, 2066-2091, 2115-2146, 2256-2287, 2389-2414, 2471-2499, 2762-2787, 2853-2878, 2911-2936, 3562-3587, 3814-3839, 4006-4031, 4056-4083, or 4244-4269 of the MLH3 gene.

E12 The oligonucleotide of any one of E1-E6, wherein the region of at least 10 nucleobases is complementary to an MLH3 gene corresponding to a sequence of reference mRNA NM_001040108.1 at one or more of positions 355-393, 952-984, 1177-1205, 2026-2052, 2066-2094, 2470-2498, 3159-3185, 3458-3485, or 4259-4292 of the MLH3 gene.

E13. The oligonucleotide of any one of E1-E6, wherein the oligonucleotide comprises the nucleobase sequence of any one of SEQ ID NOs. 6-4710.

E14. The oligonucleotide of any one of E1-E6, wherein the oligonucleotide comprises the nucleobase sequence of any one of SEQ ID NOs: 89, 92, 102, 107-108, 110-111, 115-116, 150, 154, 160-161, 163-164, 166, 168, 175-176, 178, 180, 182-183, 185-189, 201, 211-212, 229-231, 234-238, 241, 248-250, 254, 265-269, 282-283, 285-288, 294, 296, 319-322, 328-329, 366-368, 377-379, 381-399, 487-488, 511, 514-517, 520, 566-568, 573, 591, 593-594, 599, 602, 666, 669-670, 701-704, 728, 749-753, 755, 757, 784, 786-788, 790, 828-830, 959, 972, 974-977, 1002, 1004-1005, 1007, 1009-1013, 1086,1110-1111, 1126,1149, 1172, 1176-1181, 1185,1260, 1271-1274, 1276-1277,1297, 1302, 1387-1390, 1392-1393, 1396, 1461-1463, 1473-1474, 1482, 1490-1491, 1495, 1498-1502, 1505, 1508, 1510-1514, 1516-1518, 1525-1526, 1529-1530, 1546-1547, 1572, 1596-1597, 1721-1722, 1724-1727, 1744-1746, 1797, 1800-1802, 1824-1826, 1832,1835-1836,1859,1865-1866, 1870-1873, 1875, 1878, 1880-1882, 1911, 1914-1918, 1924, 1945-1946, 1949, 2000-2001, 2035, 2064, 2066-2067, 2090-2091, 2163, 2166, 2169-2172, 2178, 2181, 2184, 2186, 2194, 2255-2256, 2307, 2321, 2333, 2343, 2345-2346, 2353-2355, 2394-2395, 2403-2404, 2460-2462, 2489-2492, 2495, 2499-2500, 2524-2530, 2561-2562, 2591, 2595, 2616, 2644-2651, 2653-2654, 2661-2664, 2674, 2683-2685, 2687, 2690-2691, 2693-2695, 2725-2728, 2777-2782, 2784-2785, 2789, 2791-2792, 2794-2795, 2797, 2848-2852, or 2917-2918.

E15. The oligonucleotide of any one of E1-E6, wherein the oligonucleotide comprises the nucleobase sequence of any one of SEQ ID NOs: 89, 92, 102, 107-108, 111, 116, 150, 154, 160-161, 163-164, 166, 168, 175-176, 178, 180, 182-183, 185-189, 201, 211-212, 229-231, 234-236, 238, 241, 248-250, 254, 265-269, 282-283, 285-288, 294, 296, 319-320, 322, 328-329, 366-368, 377, 379, 381-399, 487-488, 511, 514-517, 520, 566-568, 573, 591, 593-594, 599, 602, 666, 669-670, 701-704, 728, 750-753, 755, 757, 784, 786-788, 790, 828-830, 972, 974-977, 1002, 1004-1005, 1009-1013, 1110-1111, 1126,1172,1176-1181, 1271-1274, 1276-1277, 1297, 1302, 1387,1390,1392-1393,1461-1463, 1474, 1482, 1490-1491, 1498-1502, 1505, 1508, 1510-1512, 1514, 1516-1518, 1525-1526, 1529-1530, 1546-1547, 1572, 1597, 1721-1722, 1724-1727, 1744-1746, 1797, 1800-1801, 1824-1826, 1832, 1835-1836, 1859, 1866, 1870-1873, 1878, 1880-1882, 1915-1917, 1924, 1945-1946, 1949, 2000-2001, 2035, 2064, 2066-2067, 2090, 2163, 2166, 2169-2172, 2178, 2181, 2184, 2186, 2194, 2255-2256, 2307, 2321, 2333, 2343, 2345, 2353, 2394-2395, 2403-2404, 2460-2462, 2489, 2491-2492, 2495, 2499, 2524-2525, 2527-2530, 2561-2562, 2591, 2595, 2616, 2644-2651, 2653-2654, 2661-2664, 2674, 2684, 2693-2695, 2725-2728, 2777-2782, 2784-2785, 2789, 2791-2792, 2794-2795, 2797, 2849-2852, or 2917-2918.

E16. The oligonucleotide of any one of E1-E6, wherein the oligonucleotide comprises the nucleobase sequence of any one of SEQ ID NOs: 89, 102, 111, 116, 150, 154, 160-161, 163-164, 166, 168, 175-176, 178, 180, 183, 185-189, 201, 211-212, 229-231, 235-236, 238, 241, 250, 254, 265-269, 282-283, 286-288, 294, 296, 319, 322, 328, 366-368. 377, 379, 381-399, 511, 514-517, 567-568, 591, 593-594, 599, 602, 666, 669-670, 703, 728, 750-753, 755, 757, 784, 786-788, 828-830, 972, 974-977, 1002, 1004-1005, 1009, 1011-1012, 1110-1111, 1126, 1172, 1176-1181, 1272-1274, 1297, 1302, 1387, 1392-1393, 1461-1463, 1474, 1482, 1498-1500, 1502, 1505, 1508, 1510-1511, 1514, 1516-1518, 1525-1526, 1529-1530, 1546-1547, 1572, 1597, 1721-1722, 1725-1727, 1745-1746, 1800-1801, 1824, 1832, 1835-1836, 1859, 1866, 1870-1872, 1878, 1880-1882, 1916, 1924, 1946, 1949, 2000-2001, 2066, 2090, 2163, 2169-2171, 2178, 2181, 2186, 2255-2256, 2307, 2321, 2333, 2394, 2403-2404, 2460-2462, 2489, 2491-2492, 2495, 2499, 2524-2525, 2527-2530, 2561, 2591, 2616, 2644, 2646, 2649-2651, 2653-2654, 2661-2664, 2684, 2693-2695, 2726-2728, 2777-2780, 2782, 2784-2785, 2791-2792, 2794-2795, 2797, 2849-2850, 2852, or 2917-2918.

E17. The oligonucleotide of any one of E1-E6, the oligonucleotide comprises the nucleobase sequence of any one of SEQ ID NOs: 160-161, 163-164, 166, 211-212, 230-231, 267-268, 282, 294, 322, 366-367, 391-394, 399, 514-515, 594, 602, 728, 750, 752-753, 755, 828, 830, 975-976, 1002, 1176-1179,1274, 1387,1462-1463,1510,1514, 1529-1530, 1726-1727, 1745-1746, 1824, 1871-1872, 2090, 2256, 2528-2530, 2644, or 2792.

E18. The oligonucleotide of any one of E1-E6, the oligonucleotide comprises the nucleobase sequence of any one of SEQ ID NOs: 164, 186-187, 212, 235, 322, 367-368, 379, 384-385, 388-389, 391-392, 395, 515, 594, 703, 751-753, 828-830, 1005, 1176-1180, 1274, 1297, 1302, 1387, 1393, 1463, 1511, 1514, 1745, 1824, 1881, 2256, 2404, 2491, 2528, 2530, or 2646

E19. The oligonucleotide of any one of E1-E6, the oligonucleotide comprises the nucleobase sequence of any one of SEQ ID NOs: 174-176, 178, 180-187, 566-569, 573, 701-704, 1260-1261, 1274-1277, 1510-1513, 2000-2001, 2194, 2196, 2661-2664, or 2666.

E20. The oligonucleotide of any one of E1-E6, wherein the nucleobase sequence of the oligonucleotide consists of any one of SEQ ID NOs: 6-4710.

E21. The oligonucleotide of any one of E1-E6, wherein the oligonucleotide consists of the nucleobase sequence of any one of SEQ ID NOs. 89, 92, 102, 107-108, 110-111, 115-116, 150, 154, 160-161, 163-164, 166, 168, 175-176, 178, 180, 182-183, 185-189, 201, 211-212, 229-231, 234-238, 241, 248-250, 254, 265-269, 282-283, 285-288, 294, 296, 319-322, 328-329, 366-367-368, 377-379, 381-399, 487-488, 511, 514-517, 520, 566-568, 573, 591, 593-594, 599, 602, 666, 669-670, 701-704, 728, 749-753, 755, 757, 784, 786-788, 790, 828-830, 959, 972, 974-977, 1002, 1004-1005, 1007, 1009-1013, 1086, 1110-1111, 1126, 1149, 1172, 1176-1181, 1185, 1260, 1271-1274, 1276-1277, 1297, 1302, 1387-1390, 1392-1393, 1396, 1461-1463, 1473-1474, 1482, 1490-1491, 1495, 1498-1502, 1505,1508,1510-1514, 1516-1518,1525-1526, 1529-1530,1546-1547, 1572, 1596-1597, 1721-1722, 1724-1725-1726-1727, 1744-1746, 1797, 1800-1802, 1824-1826, 1832, 1835-1836, 1859, 1865-1866, 1870-1873, 1875, 1878, 1880-1882, 1911, 1914-1918, 1924, 1945-1946, 1949, 2000-2001, 2035, 2064, 2066-2067, 2090-2091, 2163, 2166, 2169-2172, 2178, 2181, 2184, 2186, 2194, 2255-2256, 2307, 2321, 2333, 2343, 2345-2346, 2353-2355, 2394-2395, 2403-2404, 2460-2462, 2489-2492, 2495, 2499-2500, 2524-2530, 2561-2562, 2591, 2595, 2616, 2644-2651, 2653-2654, 2661-2664, 2674, 2683-2685, 2687, 2690-2691, 2693-2695, 2725-2728, 2777-2782, 2784-2785, 2789, 2791-2792, 2794-2795, 2797, 2848-2852, or 2917-2918.

E22 The oligonucleotide of any one of E1-E6, wherein the oligonucleotide consists of the nucleobase sequence of any one of SEQ ID NOs: 89, 92, 102, 107-108, 111, 116, 150, 154, 160-161, 163-164, 166, 168, 175-176, 178, 180, 182-183, 185-189, 201, 211-212, 229-231, 234-236, 238, 241, 248-250, 254, 265-269, 282-283, 285-288, 294, 296, 319-320, 322, 328-329, 366-368, 377, 379, 381-399, 487-488, 511, 514-517, 520, 566-568, 573, 591, 593-594, 599, 602, 666, 669-670, 701-704, 728, 750-753, 755, 757, 784, 786-788, 790, 828-830, 972, 974-977, 1002, 1004-1005, 1009-1013, 1110-1111, 1126,1172, 1176-1181, 1271-1274, 1276-1277, 1297, 1302, 1387, 1390, 1392-1393, 1461-1462-1463, 1474, 1482, 1490-1491, 1498-1502, 1505, 1508, 1510-1512, 1514, 1516-1518, 1525-1526, 1529-1530, 1546-1547, 1572, 1597, 1721-1722, 1724-1727, 1744-1746, 1797, 1800-1801, 1824-1826, 1832, 1835-1836, 1859,1866, 1870-1873, 1878, 1880-1882, 1915-1917, 1924, 1945-1946, 1949, 2000-2001, 2035, 2064, 2066-2067, 2090, 2163, 2166, 2169-2172, 2178, 2181, 2184, 2186, 2194, 2255-2256, 2307, 2321, 2333, 2343, 2345, 2353, 2394-2395, 2403-2404, 2460-2462, 2489, 2491-2492, 2495, 2499, 2524-2525, 2527-2530, 2561-2562, 2591, 2595, 2616, 2644-2651, 2653-2654, 2661-2664, 2674, 2684, 2693-2695, 2725-2728, 2777-2782, 2784-2785, 2789, 2791-2792, 2794-2795, 2797, 2849-2852, or 2917-2918.

E23. The oligonucleotide of any one of E1-E6, wherein the oligonucleotide consists of the nucleobase sequence of any one of SEQ ID NOs. 89, 102, 111, 116, 150, 154, 160-161, 163-164, 166, 168, 175-176, 178, 180, 183, 185-189, 201, 211-212, 229-231, 235-236, 238, 241, 250, 254, 265-269, 282-283, 286-288, 294, 296, 319, 322, 328, 366-368, 377, 379, 381-399, 511, 514-517, 567-568, 591, 593-594, 599, 602, 666, 669-670, 703, 728, 750-753, 755, 757, 784, 786-788, 828-830, 972, 974-977, 1002, 1004-1005, 1009, 1011-1012, 1110-1111, 1126, 1172, 1176-1181, 1272-1274, 1297, 1302, 1387, 1392-1393, 1461-1463, 1474, 1482, 1498-1500, 1502, 1505, 1508, 1510-1511, 1514, 1516-1518, 1525-1526, 1529-1530, 1546-1547, 1572, 1597, 1721-1722, 1725-1727, 1745-1746, 1800-1801, 1824, 1832, 1835-1836, 1859, 1866, 1870-1872, 1878, 1880-1882, 1916, 1924, 1946, 1949, 2000-2001, 2066, 2090, 2163, 2169-2171, 2178, 2181, 2186, 2255-2256, 2307, 2321, 2333, 2394, 2403-2404, 2460-2462, 2489, 2491-2492, 2495, 2499, 2524-2525, 2527-2530, 2561, 2591, 2616, 2644, 2646, 2649-2651, 2653-2654, 2661-2664, 2684, 2693-2695, 2726-2728, 2777-2780, 2782, 2784-2785, 2791-2792, 2794-2795, 2797, 2849-2850, 2852, or 2917-2918.

E24. The oligonucleotide of any one of E1-E6, wherein the oligonucleotide consists of the nucleobase sequence of any one of SEQ ID NOs: 160-161, 163-164,166, 211-212, 230-231, 267-268, 282, 294, 322, 366-367, 391-394, 399, 514-515, 594, 602, 728, 750, 752-753, 755, 828, 830, 975-976, 1002, 1176-1179, 1274, 1387, 1462-1463, 1510, 1514, 1529-1530, 1726-1727, 1745-1746, 1824, 1871-1872, 2090, 2256, 2528-2530, 2644, or 2792.

E25. The oligonucleotide of any one of E1-E6, wherein the oligonucleotide consists of the nucleobase sequence of any one of SEQ ID NOs: 164,186-187, 212, 235, 322, 367-368, 379, 384-385, 388-389, 391-392, 395, 515, 594, 703, 751-753, 828-830, 1005, 1176-1180, 1274, 1297, 1302, 1387, 1393, 1463, 1511, 1514, 1745, 1824, 1881, 2256, 2404, 2491, 2528, 2530, or 2646.

E26. The oligonucleotide of any one of E1-E6, wherein the oligonucleotide consists of the nucleobase sequence of any one of SEQ ID NOs: 174-176, 178, 180-187, 566-569, 573, 701-704, 1260-1261, 1274-1277, 1510-1513, 2000-2001, 2194, 2196, 2661-2664, or 2666.

E27. The oligonucleotide of any one of E1-E26, wherein the oligonucleotide exhibits at least 50% mRNA inhibition at a 20 nM oligonucleotide concentration when determined using a cell assay when compared with a control cell.

E28. The oligonucleotide of any one of E1-E26, wherein the oligonucleotide exhibits at least 60% mRNA inhibition at a 20 nM oligonucleotide concentration when determined using a cell assay when compared with a control cell.

E29. The oligonucleotide of any one of E1-E26, wherein the oligonucleotide exhibits at least 70% mRNA inhibition at a 20 nM oligonucleotide concentration when determined using a cell assay when compared with a control cell.

E30 The oligonucleotide of any one of E1-E26, wherein the oligonucleotide exhibits at least 85% mRNA inhibition at a 20 nM oligonucleotide concentration when determined using a cell assay when compared with a control cell.

E31. The oligonucleotide of any one of E1-E26, wherein the oligonucleotide exhibits at least 50% mRNA inhibition at a 2 nM oligonucleotide concentration when determined using a cell assay when compared with a control cell.

E32. The oligonucleotide of any one of E1-E26, wherein the oligonucleotide exhibits at least 60% mRNA inhibition at a 2 nM oligonucleotide concentration when determined using a cell assay when compared with a control cell.

E33 The oligonucleotide of any one of E1-E26, wherein the oligonucleotide exhibits at least 70% mRNA inhibition at a 2 nM oligonucleotide concentration when determined using a cell assay when compared with a control cell.

E34. The oligonucleotide of any one of E1-E26, wherein the oligonucleotide exhibits at least 85% mRNA inhibition at a 2 nM oligonucleotide concentration when determined using a cell assay when compared with a control cell.

E35. The oligonucleotide of any one of E1-E34, wherein the oligonucleotide comprises at least one alternative internucleoside linkage.

E36. The oligonucleotide of E35, wherein the at least one alternative internucleoside linkage is a phosphorothioate internucleoside linkage.

E37. The oligonucleotide of E35, wherein the at least one alternative internucleoside linkage is a 2'-alkoxy internucleoside linkage E38. The oligonucleotide of E35, wherein the at least one alternative internucleoside linkage is an alkyl phosphate internucleoside linkage.

E39. The oligonucleotide of any one of E1-E38, wherein the oligonucleotide comprises at least one alternative nucleobase.

E40. The oligonucleotide of E39, wherein the alternative nucleobase is 5-methylcytosine, pseudouridine, or 5-methoxyuridine.

E41 The oligonucleotide of any one of E1-E40, wherein the oligonucleotide comprises at least one alternative sugar moiety.

E42 The oligonucleotide of E41, wherein the alternative sugar moiety is 2'-OMe or a bicyclic nucleic acid.

E43. The oligonucleotide of any one of E1-E42, wherein the oligonucleotide further comprises a ligand conjugated to the 5' end or the 3' end of the oligonucleotide through a monovalent or branched bivalent or trivalent linker.

E44. The oligonucleotide of any one of E1-E43, wherein oligonucleotide comprises a region complementary to at least 17 contiguous nucleotides of a MLH3 gene.

E45 The oligonucleotide of any one of E1-E43, wherein oligonucleotide comprises a region complementary to at least 19 contiguous nucleotides of a MLH3 gene.

E46 The oligonucleotide of any one of E1-E43, wherein the oligonucleotide compnses a region complementary to 19 to 23 contiguous nucleotides of a MLH3 gene.

E47 The oligonucleotide of any one of E1-E43, wherein the oligonucleotide comprises a region complementary to 19 contiguous nucleotides of a MLH3 gene.

E48. The oligonucleotide of any one of E1-E43, wherein the oligonucleotide comprises a region complementary to 20 contiguous nucleotides of a MLH3 gene.

E49. The oligonucleotide of any one of E1-E43, wherein the oligonucleotide is from about 15 to 25 nucleosides in length.

E50. The oligonucleotide of any one of E1-E43, wherein the oligonucleotide is 20 nucleosides in length.

E51. A pharmaceutical composition comprising one or more of the oligonucleotides of any one of E1-E50 and a pharmaceutically acceptable carrier or excipient E52. A composition comprising one or more of the oligonucleotide of any one of E1-E50 and a lipid nanoparticle, a polyplex nanoparticle, a lipoplex nanoparticle, or a liposome.

E53. A method of inhibiting transcription of MLH3 in a cell, the method comprising contacting the cell with one or more of the oligonucleotides of any one of E1-E50, the pharmaceutical composition of E51, or the composition of E52 for a time sufficient to obtain degradation of an mRNA transcript of a MLH3 gene, inhibits expression of the MLH3 gene in the cell.

E54. A method of treating, preventing, or delaying the progression a trinucleotide repeat expansion disorder in a subject in need thereof, the method comprising administering to the subject one or more of the oligonucleotides of any one of E1-E50, the pharmaceutical composition of E51, or the composition of E52.

E55 A method of reducing the level and/or activity of MLH3 in a cell of a subject identified as having a trinucleotide repeat expansion disorder, the method comprising contacting the cell with one or more of the oligonucleotides of any one of E1-E50, the pharmaceutical composition of E51, or the composition of E52.

E56. A method for inhibiting expression of an MLH3 gene in a cell comprising contacting the cell with one or more of the oligonucleotides of any one of E1-E50, the pharmaceutical composition of E51, or the composition of E52 and maintaining the cell for a time sufficient to obtain degradation of a mRNA transcript of an MLH3 gene, thereby inhibiting expression of the MLH3 gene in the cell.

E57. A method of decreasing trinucleotide repeat expansion in a cell, the method comprising contacting the cell with one or more of the oligonucleotides of any one of E1-E50, the pharmaceutical composition of E51, or the composition of E52

E58. The method of E56 or E57, wherein the cell is in a subject.

E59. The method of any one of E54, E55, and E58, wherein the subject is a human.

E60. The method of any one of E54-E58, wherein the cell is a cell of the central nervous system or a muscle cell.

E61. The method of any one of E54, E55, and E58-A60, wherein the subject is identified as having a trinucleotide repeat expansion disorder.

E62. The method of any one of E54, E55, and E57-E61, wherein the trinucleotide repeat expansion disorder is a polyglutamine disease.

E63. The method of E62, wherein the polyglutamine disease is selected from the group consisting of dentatorubropallidoluysian atrophy, Huntington's disease, spinal and bulbar muscular atrophy, spinocerebellar ataxia type 1, spinocerebellar ataxia type 2, spinocerebellar ataxia type 3, spinocerebellar ataxia type 6, spinocerebellar ataxia type 7, spinocerebellar ataxia type 17, and Huntington's disease-like 2.

E64. The method of any one of E54-E61, wherein the trinucleotide repeat expansion disorder is a non-polyglutamine disease.

E65. The method of E64, wherein the non-polyglutamine disease is selected from the group consisting of fragile X syndrome, fragile X-associated tremor/ataxia syndrome, fragile XE mental retardation, Friedreich's ataxia, myotonic dystrophy type 1, spinocerebellar ataxia type 8, spinocerebellar ataxia type 12, oculopharyngeal muscular dystrophy, Fragile X-associated premature ovarian failure, FRA2A syndrome, FRA7A syndrome, and early infantile epileptic encephalopathy E66. One or more oligonucleotides of any one of E1-E50, the pharmaceutical composition of E51, or the composition of E52 for use in the prevention or treatment of a trinucleotide repeat expansion disorder.

E67. The oligonucleotide, pharmaceutical composition, or composition of E65, wherein the trinucleotide repeat expansion disorder is selected from the group consisting of dentatorubropallidoluysian atrophy, Huntington's disease, spinal and bulbar muscular atrophy, spinocerebellar ataxia type 1, spinocerebellar ataxia type 2, spinocerebellar ataxia type 3, spinocerebellar ataxia type 6, spinocerebellar ataxia type 7, spinocerebellar ataxia type 17, Huntington's disease-like 2, fragile X syndrome, fragile X-associated tremor/ataxia syndrome, fragile XE mental retardation, Friedreich's ataxia, myotonic dystrophy type 1, spinocerebellar ataxia type 8, spinocerebellar ataxia type 12, oculopharyngeal muscular dystrophy, Fragile X-associated premature ovarian failure, FRA2A syndrome, FRA7A syndrome, and early infantile epileptic encephalopathy.

E68. The oligonucleotide, pharmaceutical composition, or composition of E66 or E67, wherein the trinucleotide repeat expansion disorder is Huntington's disease.

E69. The oligonucleotide, pharmaceutical composition, or composition of E66 or E67, wherein the trinucleotide repeat expansion disorder is Friedreich's ataxia.

E70 The oligonucleotide, pharmaceutical composition, or composition of E66 or E67, wherein the trinucleotide repeat expansion disorder is myotonic dystrophy type 1.

E71 The oligonucleotide, pharmaceutical composition, or composition of any of E66-E70, wherein the oligonucleotide, pharmaceutical composition, or composition is administered intrathecally E72. The oligonucleotide, pharmaceutical composition, or composition of any of E66-E70, wherein the oligonucleotide, pharmaceutical composition, or composition is administered intraventricularly.

E73. The oligonucleotide, pharmaceutical composition, or composition of any of E66-E70, wherein the oligonucleotide, pharmaceutical composition, or composition is administered intramuscularly.

E74. A method of treating, preventing, or delaying the progression a disorder in a subject in need thereof wherein the subject is suffering from trinucleotide repeat expansion disorder, comprising administering to said subject one or more of the oligonucleotides of any one of E1-E50, the pharmaceutical composition of E51, or the composition of E52

E75. The method of E74, further comprising administering an additional therapeutic agent E76. The method of E75, wherein the additional therapeutic agent is another oligonucleotide that hybridizes to an mRNA encoding the Huntingtin gene.

E77. A method of preventing or delaying progression of a trinucleotide repeat expansion disorder in a subject, the method comprising administering to the subject one or more of the oligonucleotides of any one of E1-E50, the pharmaceutical composition of E51, or the composition of E52 in an amount effective to delay progression of a trinucleotide repeat expansion disorder of the subject.

E78 The method of E77, wherein the trinucleotide repeat expansion disorder is selected from the group consisting of dentatorubropallidoluysian atrophy, Huntington's disease, spinal and bulbar muscular atrophy, spinocerebellar ataxia type 1, spinocerebellar ataxia type 2, spinocerebellar ataxia type 3, spinocerebellar ataxia type 6, spinocerebellar ataxia type 7, spinocerebellar ataxia type 17, Huntington's disease-like 2, fragile X syndrome, fragile X-associated tremor/ataxia syndrome, fragile XE mental retardation, Friedreich's ataxia, myotonic dystrophy type 1, spinocerebellar ataxia type 8, spinocerebellar ataxia type 12, oculopharyngeal muscular dystrophy, Fragile X-associated premature ovarian failure, FRA2A syndrome, FRA7A syndrome, and early infantile epileptic encephalopathy.

E79. The method of E77 or E78, wherein the trinucleotide repeat expansion disorder is Huntington's disease E80. The method of E77 or E78, wherein the trinucleotide repeat expansion disorder is Friedrich's ataxia.

E81. The method of E77 or E78, wherein the trinucleotide repeat expansion disorder is myotonic Dystrophy type 1.

E82. The method of any of E77 or E78, further comprising administering an additional therapeutic agent.

E83. The method of E82, wherein the additional therapeutic agent is an oligonucleotide that hybridizes to an mRNA encoding the Huntingtin gene.

E84 The method of any of E77-E83, wherein progression of the trinucleotide repeat expansion disorder is delayed by at least 120 days, for example, at least 6 months, at least 12 months, at least 2 years, at least 3 years, at least 4 years, at least 5 years, at least 10 years or more, when compared with a predicted progression.

E85. One or more oligonucleotides of any one of E1-E50, the pharmaceutical composition of E51, or the composition of E52, for use in preventing or delaying the progression of a trinucleotide repeat expansion disorder in a subject.

E86. The oligonucleotide, pharmaceutical composition, or composition for the use of E85, wherein the trinucleotide repeat expansion disorder is selected from the group consisting of dentatorubropallidoluysian atrophy, Huntington's disease, spinal and bulbar muscular atrophy, spinocerebellar ataxia type 1, spinocerebellar ataxia type 2, spinocerebellar ataxia type 3, spinocerebellar ataxia type 6, spinocerebellar ataxia type 7, spinocerebellar ataxia type 17, Huntington's disease-like 2, fragile X syndrome, fragile X-associated tremor/ataxia syndrome, fragile XE mental retardation, Friedreich's ataxia, myotonic dystrophy type 1, spinocerebellar ataxia type 8, spinocerebellar ataxia type 12, oculopharyngeal muscular dystrophy, Fragile X-associated premature ovarian failure, FRA2A syndrome, FRA7A syndrome, and early infantile epileptic encephalopathy.

E87. The oligonucleotide, pharmaceutical composition, or composition of E85 or E86, wherein the trinucleotide repeat expansion disorder is Huntington's disease.

E88. The oligonucleotide, pharmaceutical composition, or composition of E85 or E86, wherein the trinucleotide repeat expansion disorder is Friedrich's ataxia.

E89 The oligonucleotide, pharmaceutical composition, or composition of E85 or E85, wherein the trinucleotide repeat expansion disorder is myotonic Dystrophy type 1.

E90 The oligonucleotide, pharmaceutical composition, or composition for the use of any one of E85-E89, wherein progression of the trinucleotide repeat expansion disorder is delayed by at least 120 days, for example, at least 6 months, at least 12 months, at least 2 years, at least 3 years, at least 4 years, at least 5 years, at least 10 years or more, when compared with a predicted progression.

---

SEQUENCE LISTING (4714 sequences)

SEQ ID NO: 1 - DNA, 7911 bp, Homo sapiens
aacaactggtgcgcatgcgcactggtgtctcgcggcctggcgcgccccctccgaagcgcatgctcgtgggcacgcacgagcctcaagatccaaggtgcgcgcgtcggcgtccgaggcggttggtgtcggagaatttgttaagcgggactccaggcaattatttccagtcagagaaggaaaccagtgcctggcattctcaccatctttctacctaccatgatcaagtgcttgtcagttgaagtacaagccaaattgcgttctggtttggccataagctccttgggccaatgtgttgaggaacttgccctcaacagtattgatgctgaagcaaaatgtgtggctgtcagggtgaatatggaaaccttccaagttcaagtgatagacaatggatttgggatggggagtgatgatgtagagaaagtgggaaatcgttatttcaccagtaaatgccactcggtacaggacttggagaatccaaggttttatggtttccgaggagaggccttggcaaatattgctgacatggccagtgctgtggaaatttcgtccaagaaaaacaggacaatgaaaacttttgtgaaactgtttcagagtggaaaagccctgaaagcttgtgaagctgatgtgactagagcaagcgctgggactactgtaacagtgtataacctattttaccagcttcctgtaaggaggaaatgcatggaccctagactggagtttgagaaggttaggcagagaatagaagctctctcactcatgcacccttccatttctttctctttgagaaatgatgtttctggttccatggttcttcagctccctaaaaccaaagacgtatgttcccgattttgtcaaatttatggattgggaaagtcccaaaagctaagagaaataagttttaaatataaagagtttgagcttagtggctatatcagctctgaagcacattacaacaagaatatgcagtttttgtttgtgaacaaaagactagttttaaggacaaagctacataaactcattgactttttattaaggaaagaaagtattatatgcaagccaaagaatggtcccaccagtaggcaaatgaattcaagtcttcggcaccggtctaccccagaactctatggcatatatgtaattaatgtgcagtgccaattctgtgagtatgatgtgtgcatggagccagccaaaactctgattgaatttcagaactgggacactctcttgttttgcattcaggaaggagtgaaaatgtttttaaagcaagaaaaattatttgtggaattatcaggtgaggatattaaggaatttagtgaagataatggttttagtttatttgatgctactcttcagaagcgtgtgacttccgatgagaggagcaatttccaggaagcatgtaataatattttagattcctatgagatgtttaatttgcagtcaaaagctgtgaaaagaaaaactactgcagaaaacgtaaacacacagagttctagggattcagaagctaccagaaaaaatacaaatgatgcatttttgtacatttatgaatcaggtggtccaggccatagcaaaatgacagagccatctttacaaaacaaagacagctcttgctcagaatcaaagatgttagaacaagagacaattgtagcatcagaagctggagaaaatgagaaacataaaaaatctttcctggaacatagctctttagaaaatccgtgtggaaccagtttagaaatgtttttaagcccttttcagacaccatgtcactttgaggagagtgggcaggatctagaaatatggaaagaaagtactactgttaatggcatggctgccaacatcttgaaaaataatagaattcagaatcaaccaaagagatttaaagatgctactgaagtgggatgccagcctctgccttttgcaacaacattatggggagtacatagtgctcagacagagaaagagaaaaaaaaagaatctagcaattgtggaagaagaaatgtttttagttatgggcgagttaaattatgttccactggctttataactcatgtagtacaaaatgaaaaaactaaatcaactgaaacagaacattcatttaaaaattatgttagacctggtcccacacgtgcccaagaaacatttggaaatagaacacgtcattcagttgaaactccagacatcaaagatttagccagcactttaagtaaagaatctggtcaattgcccaacaaaaaaaattgcagaacgaatataagttatgggctagagaatgaacctacagcaacttatacaatgttttctgcttttcaggaaggtagcaaaaaatcacaaacagattgcatattatctgatacatccccctctttcccctggtatagacacgtttccaatgatagtaggaaaacagataaattaattggtttctccaaaccaatcgtccgtaagaagctaagcttgagttcacagctaggatctttagagaagtttaagaggcaatatgggaaggttgaaaatcctctggatacagaagtagaggaaagtaatggagtcactaccaatctcagtcttcaagttgaacctgacattctgctgaaggacaagaaccgcttagagaactctgatgtttgtaaaatcactactatggagcatagtgattcagatagtagttgtcaaccagcaagccacatccttaactcagagaagtttccattctccaaggatgaagattgtttagaacaacagatgcctagtttgagagaaagtcctatgaccctgaaggagttatctctctttaatagaaaacctttggaccttgagaagtcatctgaatcactagcctctaaattatccagactgaagggttccgaaagagaaactcaaacaatggggatgatgagtcgttttaatgaacttccaaattcagattccagtaggaaagacagcaagttgtgcagtgtgttaacacaagatttttgtatgttatttaacaacaagcatgaaaaaacagagaatggtgtcatcccaacatcagattctgccacacaggataattcctttaataaaaatagtaaaacacattctaacagcaatacaacagagaactgtgtgatatcagaaactcctttggtattgccctataataattctaaagttaccggtaaagattcagatgttcttatcagagcctcagaacaacagataggaagtcttgactctcccagtggaatgttaatgaatccggtagaagatgccacaggtgaccaaaatggaatttgttttcagagtgaggaatctaaagcaagagcttgttctgaaactgaagagtcaaacacgtgttgttcagattggcagcggcatttcgatgtagccctgggaagaatggtttatgtcaacaaaatgactggactcagcacattcattgccccaactgaggacattcaggctgcttgtactaaagacctgacaactgtggctgtggatgttgtacttgagaatgggtctcagtacaggtgtcaaccttttagaagcgaccttgttcttcctttccttccgagagctcgagcagagaggactgtgatgagacaggataacagagatactgtggatgatactgttagtagcgaatcgcttcagtctttgttctcagaatgggacaatccagtatttgcccgttatccagaggttgctgttgatgtaagcagtggccaggctgagagcttagcagttaaaattcacaacatcttgtatccctatcgtttcaccaaaggaatgattcattcaatgcaggttctccagcaagtagataacaagtttattgcctgtttgatgagcactaagactgaagagaatggcgaggcaggtgggaacctgctcgtgctggtggatcagcacgctgcccatgagcgtatacgtctggagcagcttatcattgattcctacgagaagcaacaggcacaaggctctggtcggaaaaaattactgtcttctactctaattcctccgctagagataacagtgacagaggaacaaaggagactcttatggtgttaccacaaaaatctggaagatctgggccttgaatttgtatttccagacactagtgattctctggtccttgtgggaaaagtaccactatgttttgtggaaagagaagccaatgaacttcggagaggaagatctactgtgaccaagagtattgtggaggaatttatccgagaacaactggagctactccagaccaccggaggcatccaagggacattgccactgactgtccagaaggtgttggcatcccaagcctgccatggggccattaagtttaatgatggcctgagcttacaggaaagttgccgccttattgaagctctgtcctcatgccagctgccattccagtgtgctcacgggagaccttctatgctgccgttagctgacatagaccacttggaacaggaaaaacagattaaacccaacctcactaaacttcgcaaaatggcccaggcctggcgtctctttggaaaagcagagtgtgatacaaggcagagcctgcagcaatccatgcctccctgtgagccaccatgagaacagaatcactggtctaaaaggaacaaagggatgttcactgtatgcctctgagcagagagcagcagcagcaggtaccagcacggccctgactgaatcagcccagtgtccctgagcagcttagacagcagggctctctgtatcagtctttcttgagcagatgattcccctagttgagtagccagatgaaattcaagcctaaagacaattcattcatttgcatccatgggcacagaaggttgctatatagtatctaccttttgctacttatttaatgataaaatttaatgacagtttgattggttgcttggtttgttatttgaagggtgtgatttttgtttttgtacagttttttttcaagcttcacatttgcgtgtatctaattcagctgatgctcaagtccaaggggtagtctgccttcccaggctgcccccagggtttctgcactggtcccctcttttcccttcagtcttcttcacttccctatgctgctgcttcatgtgctacatctcagacttaaagagtttctctactacagtgaaaacattctctagggtctttcatcaggcctttagttattttagggataaaaactattgataaaaaggacaaggatagaacagagaaaatttaaagtcctgttccgggttttttgttatgttttctttaaaaactcagagactgatgttcaatatcccaaaccagtaaaatggtgaaaatactatgagcttgttttttaaaatatgattttttttggtactttataaagtatctctttatgtgaaagcaattgtcatatcaaaacacagcatacatacgttcaacctaaccaaatatctttacactttttctttcaggagacaagggttctttgggtccctttcaaacggtatcttggtgttattacattatgcctatctattgcccttataatatcacttgggaccaggactgatcgttctgcaaatgcttgttatgccattctcaatctatttttcccgcaccttttcacatgatttgtggttaataggactcaacagactaaaattgcatagtagaaaaaaaatgcaaaaagccagctggtaatgtttattgcaactggggtgctatacaattagtaagatgatgcaatgagaatttctacttttgtatttcctgaccagcctgctcaaagtggcttttatatcaattgaatgattttcctcattttttaatacaggaaaccaattcgtgctcatggaagaaaagttcctttgccagcagccttgaagtgaatcttacaggagcaatgaaagtattgcattcattagcgtctgccccagagaaggttcagagaaaaccttcacttgttttcaaggggatccttgtagatttacgtaattggaatcctgaagaacaggccctactgtctaaaaaatggcttttattcttctaaatacatataaacggatgttttatagatgggaagacatgaccttagaaaggagagagttttcagaggatttgccaggctgtcaggggctctgcctccaggcccagtgtggcagtgtggcctcagggcctccgcctccctgcttgagggctgcatggaggccaactgtcctgggagttgtaaaaatcttttaaggccagaccaatttgagggattttaaaaagtgtctcagtgcctcttatgatttcagaaggttttgctatatgtaatcccaactactgttttcttgagagtagcagaggattagaaaaagtcctccataaattatgtaaccggccttcctgactagcctgactcaagcaatgtaagagataattattctgttttcataatttataagtgtgggggcatgcctcagcataaaaacaacctattagggaaaaatatctaatagattacctttatcgcctgttagggttttatgttgtttttaactcagatgccataagaacaaagatacatgtaatttataatagtaatcattaatacctatattgtgctttaaggtttacaaaataatttttctcatactttatcttagtttagtttcttgacagtccatgaggtaaggtggtagctttatcaccattttacaaagtgggaaacgaaggttcctcttaggaacctagttgtcacctttgtataataaaacttcgaagctcggagctgttaactggtttgctgaaggcttagctgtaagagccagaattcagacccaggtctgagtgacttcaaactgcacagtccttcccattattacccatatgctatcccttatatttttaatttattaggaattcattcatttataaacttggtgattcacctttattagattctggtcgctgaaggctttagtaacttcagagtaaaacttgagagatgagatgtaaaatgcagccattcttgagagttcctttttctgtaacattcatcaacacttcattgagaagtgaaggttcctatggctgtctctaccttcaagaggcttagctttagtcactgagaaagacaaggaaactaatgatagaatatagtagcttcttctggcgttaggtatcacagagtcacagctagttacagctagccctttattattgaaagaagaggagctagcagtcccactatcagaattaagactagagatggtaataggagctagtatcagaaaagcttaaggcaaagcataaagtgtaggctagaatgaagctggagaatggggagggggcttgggtaacatccagaacctggctggggacctggaactacatgagatgtaagaatggagaggttctagcagtcagaggtcaggtacaaatgaacagctgggatctgcgcatggcagacagtgaaaaaacccaggcaagcaaaatggtcagagcagaaaggggcccaaggccacgttcttgagatgtggagggggctgaggaagccacgccaagtaaggacagatgcagctcagcagttcctagcgagccctgacaagccagctcagctgaagcttcgggtgggagccagtcatggcacagtggagtgaaggaagagcagtttcaggcacccaaaacctgacccccacgacctgttttccacctgaagagccacccattccatccaaacccttggcaaaagtctgctaacagagagaaccggccagtatgctggccagtcgcgatcatgcctgtctttaccctctaagctgaagctgctcatcaacggtgagatggcaaaaaggtgggtccagaagaggggaaaagaagggagtctgtgaaaacaaaatgctgaagaatctgcatcaaataaacccttccttccttcctttttccttcaaaaaaaaaaaaaaa

SEQ ID NO: 2 - protein, 1453 aa, Homo sapiens
MIKCLSVEVQAKLRSGLAISSLGQCVEELALNSIDAEAKCVAVRVNMETFQVQVIDNGFGMGSDDVEKVGNRYFTSKCHSVQDLENPRFYGFRGEALANIADMASAVEISSKKNRTMKTFVKLFQSGKALKACEADVTRASAGTTVTVYNLFYQLPVRRKCMDPRLEFEKVRQRIEALSLMHPSISFSLRNDVSGSMVLQLPKTKDVCSRFCQIYGLGKSQKLREISFKYKEFELSGYISSEAHYNKNMQFLFVNKRLVLRTKLHKLIDFLLRKESIICKPKNGPTSRQMNSSLRHRSTPELYGIYVINVQCQFCEYDVCMEPAKTLIEFQNWDTLLFCIQEGVKMFLKQEKLFVELSGEDIKEFSEDNGFSLFDATLQKRVTSDERSNFQEACNNILDSYEMFNLQSKAVKRKTTAENVNTQSSRDSEATRKNTNDAFLYIYESGGPGHSKMTEPSLQNKDSSCSESKMLEQETIVASEAGENEKHKKSFLEHSSLENPCGTSLEMFLSPFQTPCHFEESGQDLEIWKESTTVNGMAANILKNNRIQNQPKRFKDATEVGCQPLPFATTLWGVHSAQTEKEKKKESSNCGRRNVFSYGRVKLCSTGFITHVVQNEKTKSTETEHSFKNYVRPGPTRAQETFGNRTRHSVETPDIKDLASTLSKESGQLPNKKNCRTNISYGLENEPTATYTMFSAFQEGSKKSQTDCILSDTSPSFPWYRHVSNDSRKTDKLIGFSKPIVRKKLSLSSQLGSLEKFKRQYGKVENPLDTEVEESNGVTTNLSLQVEPDILLKDKNRLENSDVCKITTMEHSDSDSSCQPASHILNSEKFPFSKDEDCLEQQMPSLRESPMTLKELSLFNRKPLDLEKSSESLASKLSRLKGSERETQTMGMMSRFNELPNSDSSRKDSKLCSVLTQDFCMLFNNKHEKTENGVIPTSDSATQDNSFNKNSKTHSNSNTTENCVISETPLVLPYNNSKVTGKDSDVLIRASEQQIGSLDSPSGMLMNPVEDATGDQNGICFQSEESKARACSETEESNTCCSDWQRHFDVALGRMVYVNKMTGLSTFIAPTEDIQAACTKDLTTVAVDVVLENGSQYRCQPFRSDLVLPFLPRARAERTVMRQDNRDTVDDTVSSESLQSLFSEWDNPVFARYPEVAVDVSSGQAESLAVKIHNILYPYRFTKGMIHSMQVLQQVDNKFIACLMSTKTEENGEAGGNLLVLVDQHAAHERIRLEQLIIDSYEKQQAQGSGRKKLLSSTLIPPLEITVTEEQRRLLWCYHKNLEDLGLEFVFPDTSDSLVLVGKVPLCFVEREANELRRGRSTVTKSIVEEFIREQLELLQTTGGIQGTLPLTVQKVLASQACHGAIKFNDGLSLQESCRLIEALSSCQLPFQCAHGRPSMLPLADIDHLEQEKQIKPNLTKLRKMAQAWRLFGKAECDTRQSLQQSMPPCEPP

SEQ ID NO: 3 - DNA, 5533 bp, Mus musculus
gggagcgcgcgctcggcgttggaggtggttggtcggtgagagttgatggaggagattcgaggtgattattttccagtcagagaaggaagccagtgtctgccactccctccacatgtgtccctgccatgatcaggtgtctatcagatgacgtaaaaaccaagttgcgttccggtttagccataagctccttgggccagtgtgttgaagaacttacccttaacagtattgatgctgaagcaacatgtgtggccatcagagtgaatatggaaaccttccaagttcaagtgatagacaatggacttgggatggcgggggacgatgtagagaaggtgggaaaccggtattttactagtaaatgccactcagtgcgggacttggagaacccagcattttatggcttccgaggagaggccttggcaagtatagccgacatggctggtgctgtggagatttcatccaagaaaaacacaacactgaaaacctttgtgaaaatgtttcagaatggaaaagcccttgccacccatgaggctgatttgaccagaccaagtgtggggactacagtaacggtctataacctgttttaccagtttcctgtgcggaggaaaagcatggatcctagactagagtttgagaaagttcggcagagggtagaagctctctcacttatgcacccctccatttctttctctttgaggaacgatgtatctggatccatggttcttcagctccctaaaaccaaagacatatgctctcgattctgtcaaatttacggattgggcaagtcccaaaagttaagagaaatacgttttaaatacaaggaatttgagttcagtggctacatcagctctgaagcacactacaataagaatatgcagtttttgtttgtgaacagaagactagttttaagaacaaagttgcataaacttattgactttttattaagaaaagaaagcattatatgcaggccaaagaatggctctgccagtaggcaaatgaattcaagtcctcgacaccgttctgcctcagaactccacgggatatatgtaatcaatgtgcagtgccctttctgtgagtatgatgtctgcatagagccagccaaaactctgattgagtttcagagctgggataccgtgttgatttgtattcaggaaggagtaaaaaggtttttaaagcaagaaaaattatttgtagaattatcaggtgaagatattaaggaatttaatgaagataatggttttagtttgtttggcacgactcttcagacacatgtgtctactcatgagaagtgtgaccagagcagtttccgggaagcgtgtaataaaattctggattcctatgaaatgtttaatttgcagtcaaaagctgtgaaaagaatagctactctagaaaataaaaccagacaaaaccctggtgattcagaaactatcagaaaaaagacagtgggctcattgtacacagatgcatcggatggcccgtgctatagtaaatcggtagagtctgttttacaggacagcaacaacagtgcttacttagaaccgagggtgtcagaagaagaggtagccaaaacatcacactccggagaaaatgagaaatggaaaaaatcttttttggaaaataagacttcaggaaggatacatgaaaccagtccaaaaatgttttcaagccccatccaaatgcatcacctccttgaggagagagaggcagatctggaaatgcagacaataagtagtactgttaatgtcatggctgccaacattccccaaaataatgacattccgagtcaactggagaaatggaaagatgctcctgaagtggggtgccaacctctgccttttgagacaaccttattaagggtacggggtactcagaggaagaaggaaagaaggaaaaaggagcccagtagtcgtggaagagtaaatgtttttagttatggacaagttaaattatgctccactggctttataactcatgtagtacaaagtgagcacgctaaatcaactgaaacagaacattcatttaaaaattatgctcgacctggtcctgtaagtgcccaagaaacatttggaaaaagaacacaccatgcaattgagactccagacagcagtgatttaacaagcactttaagtaaagaatccagtcaaccgcccaacaaaaggttttgcagaacaaatacaggttacgggacagagaacaaacctgtagcaacagatgacaacttggctctttttcaggaaagctgtaaagaatcacacacagatcgccttttgcctgatgcatcctccttcccatggtgtagatatgtttccgatggttgtaggaaaatagataaaaggggttccttcaaacaggtagtccgtaggaagctaagcttgcgttcacaagtagggtctttagagaagtttaagaggcagtatgggaaggtcagcagttccctagatacagaaaaggataataacactgaagtcaggactcatcttgatcctcaaaatgaacccgatgttcttctgaaagacaagagccacttagatatgtctgatggttgtgagatcactactgtggagcacagtgagacttgtcaaccattaagtcccatcctgtacccagaaaaaattttattttccaaagaagatcgcttagaacagatgcctcatttgagagaaagtcctataactctggaagaattatctcactgtaacagaaaagctgatgttgagaagtccgctgcatcactggcttctaaattatccaaactaaaggattctgaaaaagagatgcaaaccgtggggatgacaggtcatactagtgaacttccagattcaaatcccagttggaaagataatagccagtgcactaggttagacttggatttttgtgaattattaaaaaacaaacttgaaaaaatagagagtgatatgcttccaatggcagattctgccacagaggatggtcccatcaataaaaacagtgaactacatcctaacaatacaacggatgacacagagaaaccagaaactcctttgctgttcccctgtaatgattctaaaatcagcagagattcagatgttcttatcagaacttcagaacaacctacaggaaaccctgactctgtcggtaaagtgataatgagtcaggtagaggatggcattggcagccaaggtggagtctgtccccagggtgatgaatctaaggcaagatcttgttccaaaaatgaaccaaacgcacactgtatggattggcagcagcattttgatgtaaccctgggaagaatggtttacatcaacagaatgacaggacttagcacattcgttgctccaactgacgaccttcatactgcttgtactaaagatctgacaactgtggctgtggatgtcctgcttgggaatgatgctgtggatgctgctgctgctgctgtcagtgaaccccttcagtctctgttttcagaatggagcaatccagtgtttgctcgatacccagaggttgctgttgatgtcagcagtggccaggctgagagcttagccgttaaaattcacaacgtcctgtatccctatcgcttcaccaaagagatgattcactcagtgaaggttctccagcaagtggataacaagtttattgcctgcttaatgagcacgaggatggatgaggatggccgaacaggtggaaacctgttagtcctggtggaccagcatgctgcccatgaacgcattcgtttggagcagcttattactgattcctatgagaaacaagatccacaaagcgctggccggaagaaattattgtcttccacaataatccctccactggcaatcaccgtgtcagaggaacaaaggagactcttacggtcttaccacaaacatttagaagatctggggcttgagttgctctttccagatgctagtgattctctgatcctggtgggaaaagtgccgctctgctttgtagagagagaagctagtgagcttcgaagaggacgctctactgtgactaagagtattgtggaggaattaattcgagaacaagtggagctgctccagaccacaggaggtatccaagggacactgccactgactgtccagaaggtgttggcctcccaggcctgccatggggctattaagtttaatgatcgtctgagcctagaagagagctgccgcctcatcgaagctctgtccttgtcccagctgccatttcagtgtgctcatgggagaccctcaatgctgcccttagctgacctggaccacttggagcaggaaaaacaggttaaacccaaccttgctaaacttcgcaaaatggttcgtgcctggcatctctttggaaaaacagagcagaacctgcagcagcctatacgtccttgtgagcctccatgaggagaggattctggagtgtaaggagacaagggagtgccgtgcatcccgagcaggagcagtgcagctgtgggcaggtcggcggccctgagcgggctggcacatcagtccccctgagcagatggagcaggcacgtgcactcaagcctaagggtagtttatttctttgcatccatgcacacaggagcttgacatataatacctatcttttgtaagttgatttagtgataaaatgtaatgattttgtaattggtgagttggcttatgtttgaggggcgcagctattgtttttagcagttttccccagcctctcagtttatattacgtgaggatgctaagccctaagcgctggtctgctcttctctgagcccctggctctgcccctccccatccatttctcttttgcatttgtctccttcacttcatacctctgcttcttcacattgtgctttacagacttacggtgtttctctgctcattataaaaatatttcccgccaggcagcggtggctcacacctttagtcccagtacttgggaggcagaggcaggtggatttctgatttcaaggccagcctggtctgcaaagtgagttccaggacagccacagggctacaaagagaaaccctgtctcaaaaaaaccaaaacaacaacaacaacaacaaaacttcctgatgtcttccagagagactaaattatattagggattaaaagttatttatagctgggtgtagtgacatatacctgtaatcctagtacctgggaggctgagacaagtccgtgacagggcaccatttgcctaggctggatatatagcaagaccttgactcaaaataaataagtaaactatagacaaagagagacacaaagacagaatagagaaagtttgaaaagaatttttttaattctcttggtaacctggctgtcctggaactggaactcagagatccccctttgctgcctccgagtgctgggattaacggtgcgcgccaccactgcctggcaagaaaaattacaaccctgtccctggtttttttgatagtcttactggtttttaaaaccagaggtgaatgtttctattctgaactaataaaacactaaaaaataatgggtttgtttttgaaaatgaatttgtactttataaaatgcttctgtgaaattaaaaaaaaaaaaaaaaa

SEQ ID NO: 4 - DNA, 5424 bp, Rattus norvegicus
ctggagcgaacaccggacgttggaggtggttagtccgtgagaattgatggaggagattcgaggtggttatttccagtcagagaaggaagccggtgtctgctactctctctgcatgtttccctgccatgatcaggtgtctgtcagatgaagtacaagccaagttgcgttctggtttagccctaagctccttaggccagtgtgttgaggaacttacccttaacagtattgatgctgaggcaacatgtgtggccatcagagtgaatatggaaaccttccaagttcaagtgatagacaacggacttgggatggcgggggatgacgtggagaaggtggggaaccggtattttactagtaaatgccactcagtacgggacctggagaacccaacgttttacggtttccgaggcgaggccttggcaagtatagctgacatggctagtgctgtggaaatttcatccaagaaaagcacaacattgaagacctttgtgaagatgtttcagaacggaaaagccctcgccgcccgtgaggcggacttgaccagaccgagtgtggggactacagtgacggtctataacctgttttaccagtttcctgtgcggaggaaaagcatggaccctagactagagtttgagaaggttaggcagagggtggaagccctctcacttatgcacccctccatttctttctctttgaggaatgacgtttctggttccatgattcttcagctccctaaaaccaaagacatatgttctcggttttgtcaaatttatggattgggcaagtcccaaaagttaagagaaatacattataagtataaggaatttgagtttaatggctacatcagctctgaagcacactacaataagaatatgcagtttttgtttgtgaacagaagactagttttaagaacaaagttgcataaacttattgactttttattaaggaaagaaagtattatatgcaggccaaagaatggctctgccagtaggcaaatgaattcaagtcctcgacaccgttctgcctcagaactccatgggatatatgtaatcaacgtgcagtgcccgttctgtgagtatgatgtctgcatagagccagccaaaactctgattgaattccagaactgggataccgtgttgatttgtgttcaggaaggaataaaaaagtttttaaagcaagaaaaattatttgtagaattatcaagtgaagatattaaggaatttaatgaagataatggttttagtttgattggtacaacacttcagacacagtctactcatgagaagtgtgaccagagcagtttccaggaagcgtgtaataatattttggattcctatgaaatgtttaatttgcagtcaaaagctgtgaaaagaatagctactttagaaaatagaaccacacaaaattctggcgattcaggagctatcagaaaaaagacagaggactcatacacttatgaatcagatgacctgggccatagaaaaactgtagagtctgcgttatacaacagtgacagtgcttacttaggatcaaggatgtcagaagaagacatagccaaaacatcacacgctggagaaaatgagaaatggaaaaaatctttgttggaaaataggacttcagaaaggccacatgaaaccagtccaaaaatgttttcaagccccattcaaactcatcatccccttgaggagagtgaggcagatctagaaatagagatgaaaagtagtactgttaatgtcatggctgccaacattcctccaaatagtgaaattcagagtcaactggagcaacttgaagatgctcctgaagtggagtgccaacctctgccctttgagacaacattattaagagcacagggtactctgaaaaagaaggagagaaaaaaggagctcagtagccatggaagagtaaatgtttttagttatggacaggttaaattgtgctccactggctttatcactcatgtggtacaacgcgaacccgccaagtcacctgaaacagaacagttgtttaaaaattatgctcgacctggtcctgtaagtgcccaggaagcatttggaaatagaacacaccatgcaagtgagactccagacagcagtagtttaacaagcactttaagtaaagaatccactcagccgccccacaaaagattctgcagaacaaatacaggttatgggacagagaacaaacctgtagcaacagatgacaacttggccctttttcagggaagccgtaaagaatcacacacagattgctttttgcctgatacaacctcctttccgtggtgtagaaatgtttccggtggttataagaaaaaaggtaaagtgggttccttcaaacacgtagtccgtaggaagctaagcttgcgttcacaaatagggtctttagagaagtttaagaggcaatatgggaaggttaacaattccctagctgcagaagaggacaatgacactgacttcaggacccatcttgagcctcacaatgaacccgatgttcttctgaaagataagagcctctcagatatgtctgatggtggtgagatcactccatcagagcacagtgatgggtgtcaaccattacgtcccatcctgtacccagagacactttccaaagaagatcgcttagaacagaggcctagtttgagagaaagtcctatcactctggcggaattgctccacggtaacagaaaaccttctgaggttaagaagtccactgaagccctggcttctaaattatccagactcaaggattctgaaaaagagatgcaaaccatggagatggcaggtcctgttagtgaacgtccagactcagatcccagttggaaagacaatagccagtgcgctaggctggacttaaatttttgtgaattatataaaaataaacttgaaaaaacagagagtgaagtgcttccaatgccagattctgccccagaggatgattccatcaataaaaacagcgtgctgtgttctaacagtgtaacagatgacagggagaaaccagaaacttccttgctgttaccctgtagtgattctaaaatcagcaaagattcagatgttcttatcagagtctcagagcaacagagtggaagccctgactctgccagcagggaggtaacgcgtcaggtagaagatagcgccggcagccaatgtggaatctgttcccagagccatgggtttaaagcaagatcttgttctgacaatgaagaatcaagtacgcacagtatggactggcagcagcattttgacgtaaccctgggaagaacggtttacatcaacagaatgaccgggcttagcacgtttgttgctcctactgatgacattcagactccttgtactaaagatctgacaaccgtggctgtggatgtcctacttgggaatggggtccagtacaggtgtcatccttttagaagcgaccttgttcttcctttcctcccaagagctcaggaagagaggaccaggcggagacacaacagagatgctgtagatgctgctgctgtcagtgaaccacttcagtctttgttttcagaatggagcaatccagtgtttgcccgatacccagaggttgctgttgacgtcagcagtggccaggctgggagcttagccgttaagattcacaatgttctatatccctatcgcttcaccaaagagatgatccactcagtgcaggttctccagcaagtggataacaagtttatcgcctgcttaatgagctcgaggacggacgggagtggccaagcaggtggaaacctgttagtcctggtggaccagcacgctgcccatgagcgcgttcgtttggagcagctaatcactgattcctatgagaaacaagctccacaaagtgctggccggaagaaattactgtcttccacaataattcctccactagcgatcaccgtgtcagaggaacaaaggagactcttacggtcttaccacaaacatttggaagatctgggacttgagttgctctttccagatgctagtgactcttcgatcctggtgggaaaagtgccactctgctttgtagaaagagaagctaatgaacttcgaagaggacgatctcctgtgactaagagtattgtggaggaattgattcgagaacagctggagctgctccagaccacgggaggtatccaagggacactgccgctgactgtccagaaggtgttggcctcccaggcctgccacggggccattaagtttaatgatcgtctgagtctggaggagagctgtcggcttatcgaagctctgtccttgtgccagctgccatttcagtgtgctcatgggcgaccttcaatgctgcccttagctgacctggaccacttggagcaggaaaaacaggttaaacccaatcttactaaacttcgcaaaatggctcatgcctggcatctctttggaaaagcagaaggctgtgatacaaagcaggagccacaacagcccgtacctccttgtgagccaccgtgagaagagttataaggagatgggtgctgtgcccctgcgcgagcggagagcagtacagctgtgagcggtcgctggccctgggtcgctggcacatctgtcctggggcagtggagcaggcagatgcactcaagcctgagggagttgagttctttgcatccacagacacaggagtttgcacatagttcctatcttttgtaaattgacttagtgataagatgtaatgactctgaggttggtcggttggcttatgtttgaagggtgcagcagttgattttgagcagctttccccagcctctcagttcacattacgtgaggatgccctgagccctggtctgcctttctccaagcccctggtgcagcctctccgtccatccctcttttgcatttgtcttcttagcctcactcctctgcttcttcacattttgcattacagacatatggtgtctctgctcgctataaaaatatttcctgatgtcttccagagagactttaaattatattagggattaaaagttatttatagctgggtgtggtggtttacctgtaatcctagtcgcagggaggctgaggcaagtccacagcagggcaccattagccgaggctgtacatgcaagaccctgcttaaaataaataaatatgctactgacaaagagaaacacaaagatagaatagagaaagtttgaaaaaattttttaattcttttgatagcctggactgttctggaacttgctttgtagaccaggctaacctcaaactcaagagatccacctgcctctgcctcccaagtgctgggattaaaggtgtgcgccaccactgcctagaaagaaaaattgcaatcttatccctggtttttgatagtcctacggtttttaaaaccagaagtcagtgtttatatcctgaaccaataaaacattaaaaaatactaggtctgtttttgaaaatgaatttgttactttataaaatgtttctgtga

SEQ ID NO: 5 - DNA, 5028 bp, Macaca fascicularis
cacacgggaaaaaaacaaacaaacataaaaacaaaagtaaaagttacgacatagtctttcacaccatgccaaaaggggataaggattgagactgtaggtacccgttcactgaaccctggaatgcggatccttggctggaacacctgacgcgcatgcgcactggtgtgtcgtggcctggcgcgcccctccgaagagcatgctcgtggactcgcacgtgcacgagcctcaagacccaaggtgcgcgcgtcggcgtcccaggcggttggtgtccgagaattggttaagctggactcgaggcaattatttcccgtcagagaaggaaaccattgcttggcattctcaccatctttctacctaccatgatcaagtgcttgtcagttgaagtacaagccaaattgcgttctggtttggccataagctccttgggccaatgtgttgaggaacttgccctcaacagtattgatgctgaagcaaaatgtgtggctgtcagggtgaatatggaaaccttccaagttcaagtgatagacaatggatttgggatggggagtgatgatgtagagaaagtgggaaatcgttatttcaccagtaaatgccactcggtacaggacttggagaatccaaggttttatggtttccgaggagaggccttggcaaatattgccgacatggccagcgctgtggaaatttcgtccaagaaaaacaggacaatgaaaacttttgtgaaactgtttcagagtggaaaagccctgaaagcttgtgaagctgatgtgactagaccaagcggtgggaccactgtaacagtgtataacctattttaccagctgcctgtaaggaggaaatgcatggaccctagactggagtttgagaaggttaggcagaggatagaagctctctcacttatgcacccttccatctctttctctttgagaaatgatgtttctggttccatggttcttcaactccctaaaaccaaagacgtatgttcccgattttgtcaaatttatggattgggaaagtcccaaaagctgagagaaatcagttttaaatataaacagtttgagcttagtggctatatcagctctgaagcacattacaataagaatatgcagtttttgtttgtgaacaaaagactggttttaaggacaaagctacataaactcattgactttttattaaggaaagagagtattatatgcaagccaaagaacggttccaccagtaggcaaatgagttcaagtcttcggcaccggtctaccccagaactctatggcatatatgtaattaatgtgcagtgccaattctgtgagtatgatgtgtgcatggagccagccaaaactctgattgagtttcagaactgggacactctcttgttttgtattcaggaaggagtgaaaatgtttttaaagcaagaaaaattatttgtggaattatcaggtgaggatattaaggaatttagtgaagataatggttttaatttatttgatgctactcttcagaagcgtgtgacttccgatgagaggagtaaccagggcagtttccaggaagcatgtaataatattttagattcctatgagatgtttaatttgcaatcaaaatctgtgaaaagaaaagctactgcagaaaacataagcacacagaattctagggatttagaagctatcagaaaaaatacaaatgatgtatttttgtgcatttatgaatcaggtggtccaggccatagcaaaatgacagagccatctttacaaaacaaagacagctcttgctcagaatccaagatgttagaacaagagacaattgtagcatcagaagcaggagaaaatgagaaacataaaaaatcttgcctggaacatagctctttagaaaacccatgtggaaccagttcagaaatgtttttaagcccttttcagacaccatgtcactttgaagagagtggggaggatctagaaatatggaaagaaagtactactgttaatgacatggctgccaacgtcatgaaaaataatagaattcagaatcaaccagagagatttaaagatgctactgaagtgggatgccagcctctgccttttgcgacaacattattgggagtacatagtgttcagacagagaaggagaaaaaaaaagagcctagcaattgtggaggaagaaatgtttttagttacggacgagttaaattatgttccactggctttataactcatatagtacaaaatgagaaaactaaatcaactgaaacagaacatgcatttaaaaattatgttagacctggtcccacacgtgcccaagaaacatttggaaatagaacacgtcattcagttgaaactctagacctcaaagatttagctggcactttaagtagagaatctggtcaattgcccaacaaaaaaatttgcagaacaaatataagttgtgggctagagaatgaacctacagcaacttatgcaaagttttctacttttcagcaagatagcaaaaaatcacaaacaggttgcatattatctgatacatccccctctttcccctggtatagacacgtttcaaatgatagtaggaaaacagataaattaattggttcctccaaaccaatcgtccgtaagaagctaagcttgagttcacagctaggatctttagagaagtttaagaggcaatatgggaaggttgaaaatcctctggatacagaagtagaggaaagtaacggagtcactaccaatctcagtcctcaagttgaacctgacattctgctgaagaacaagaactgcttagacaactctgatgtttgtaaaatcactactatgaagcataatgattcagatagtagttgccaaccagtaagccacgtccttgactcagagaagcttccattctccaaggatgaagattgtttagaacaacagatgcctagtttgagagaaagccctatgaccctgaaggagttatctctctttaatagaaaacctttggaccttgagaagtcatctgaatcactagcctctaaattatccagacggaagggttccgaaagagaaactcaaacaatggagatgatgagtcgttttaatgaacttccaaattcagattccagtaggaaagagagcaagttgtgcagtgtgttaacacaagatttttgtatgttatttaaaaatgagcatgaaaaaacagagaatggtgtcatcccaacatcagattctgccacacaggatatttcctttaataaaaatagtaaaacacattctaacagcaatacaacagagaactgtgtgatatcagaaactcctttggtattgccctatgataattttaaagttaccagtaaagattcagatgttcttatcagagcttcagaacaacacacaggaagtccggactctcccagtggaatgttaatgaatctggtagacgatgccacaggtgaccaaaatggaatttgttttcaaagtgaggaatctaaagcaagagcttgttctgaaactgaagagtcaaacacgtgttgctcgaattggcagcagcatttcgatgtagccctggggagaatggtttatgtcaacaaaatgactggactcagcacattcattgccccaactgaggacattcaggctgcttgtactaaagacctgacaactgtggctgtggatgtcgtacttgagaatgggtctcagtacaggtgtcatccttttagaagcgaccttgttcttcctttccttccgagagctcgagcagagaggactgtgatgagacaggataacagagatactgtggatgataccattagtagcgaattgcttcagtctttgttctcagaatgggacaatccagtatttgcccgttatccagaggttgctgttgatgtaagcagtggccaggctgagagcttagcagttaaaattcacaacatcttgtatccctatcgtttcaccaaagaaatgattcattcaatgcaggttctccagcaagttgatagcaagtttattgcctgtttgatgagcactaagactgaagagaatggcgaggcaggtggaaacctgctcgtgctggtggatcagcacgctgcccatgagcgtatccgtctggagcagcttatcattgattcctatgagaagcaacaggcacaaggctctggtcggaaaaaattactgtcttctactctaattcctccactagagataacagtgacagaggaacaaaggagacttttatggtgttaccacaaaaatctggaagatctgggccttgaacttgtatttccagacactagtgattctctggtacttgtgggaaaagtaccactctgttttgtggaaagagaagccaatgaacttcggagaggaagatctactgtgaccaagagtatcgtggaggaatttatccgagaacaagtggagctgctccagaccacaggaggcatccaagggacattgccactgactgtccagaaggtgttggcatcccaagcctgccatggggccattaagtttaatgatggcctgagcttacaggaaagttgccgccttattgaaactctgtcctcatgccagctgccattccagtgtgctcacgggagaccttctatgctgccattagctgacatagaccacttggagcaggaaaaacagattaaacccaatctcgctaaacttcgcaaaatggcccaggcctggcgtctctttggaaaagcagagtgtgatacaacgcagagcctgcagcaatccatgcctccctgtgagccaccatgagaacagaatcactggtctaaaggaacaaagggattttcactgtatgcctctgagcagagagcagcagcagcaggtaccagcacggccctgactgaatcagcccagtgtccctgagcagcttagacaacagggctctttgtatcagtatttcttgagcagatgattcctctagttgagtagccagatggaattcaagcctaaagacagttcattcatttgcatccatggacacagaaggttgccatatagtatctaccttttgctacttatttaatgataaaatttaatgatcgtttga

SEQ ID NO: 6 - DNA, 20 bp, Artificial sequence
  Synthetic oligonucleotide
cttggatcttgaggctcgtg

SEQ ID NO: 7 - DNA, 20 bp, Artificial sequence
  Synthetic oligonucleotide
ccttggatcttgaggctcgt

SEQ ID NO: 8 - DNA, 20 bp, Artificial sequence
  Synthetic oligonucleotide
accttggatcttgaggctcg

SEQ ID NO: 9 - DNA, 20 bp, Artificial sequence
  Synthetic oligonucleotide
caccttggatcttgaggctc

SEQ ID NO: 10 - DNA, 20 bp, Artificial sequence
  Synthetic oligonucleotide
gcaccttggatcttgaggct

SEQ ID NO: 11 - DNA, 20 bp, Artificial sequence
  Synthetic oligonucleotide
aattctccgacaccaaccgc

SEQ ID NO: 12 - DNA, 20 bp, Artificial sequence
  Synthetic oligonucleotide
aaattctccgacaccaaccg

SEQ ID NO: 13 - DNA, 20 bp, Artificial sequence
  Synthetic oligonucleotide
caaattctccgacaccaacc

SEQ ID NO: 14 - DNA, 20 bp, Artificial sequence
  Synthetic oligonucleotide
acaaattctccgacaccaac

SEQ ID NO: 15 - DNA, 20 bp, Artificial sequence
  Synthetic oligonucleotide
aacaaattctccgacaccaa

SEQ ID NO: 16 - DNA, 20 bp, Artificial sequence
  Synthetic oligonucleotide
taacaaattctccgacacca

SEQ ID NO: 17 - DNA, 20 bp, Artificial sequence
  Synthetic oligonucleotide
ttaacaaattctccgacacc

SEQ ID NO: 18 - DNA, 20 bp, Artificial sequence
  Synthetic oligonucleotide
cttaacaaattctccgacac

SEQ ID NO: 19 - DNA, 20 bp, Artificial sequence
  Synthetic oligonucleotide
gcttaacaaattctccgaca

SEQ ID NO: 20 - DNA, 20 bp, Artificial sequence
  Synthetic oligonucleotide
cgcttaacaaattctccgac

SEQ ID NO: 21 - DNA, 20 bp, Artificial sequence
  Synthetic oligonucleotide
ccgcttaacaaattctccga

SEQ ID NO: 22 - DNA, 20 bp, Artificial sequence
  Synthetic oligonucleotide
cccgcttaacaaattctccg

SEQ ID NO: 23 - DNA, 20 bp, Artificial sequence
  Synthetic oligonucleotide
tcccgcttaacaaattctcc

SEQ ID NO: 24 - DNA, 20 bp, Artificial sequence
  Synthetic oligonucleotide
gtcccgcttaacaaattctc

SEQ ID NO: 25 - DNA, 20 bp, Artificial sequence
  Synthetic oligonucleotide
agtcccgcttaacaaattct

SEQ ID NO: 26 - DNA, 20 bp, Artificial sequence
  Synthetic oligonucleotide
gagtcccgcttaacaaattc

SEQ ID NO: 27 - DNA, 20 bp, Artificial sequence
  Synthetic oligonucleotide
ggagtcccgcttaacaaatt

SEQ ID NO: 28 - DNA, 20 bp, Artificial sequence
  Synthetic oligonucleotide
tggagtcccgcttaacaaat

SEQ ID NO: 29 - DNA, 20 bp, Artificial sequence
  Synthetic oligonucleotide
ctggagtcccgcttaacaaa

SEQ ID NO: 30 - DNA, 20 bp, Artificial sequence
  Synthetic oligonucleotide
cctggagtcccgcttaacaa

SEQ ID NO: 31 - DNA, 20 bp, Artificial sequence
  Synthetic oligonucleotide
ttgcctggagtcccgcttaa

SEQ ID NO: 32 - DNA, 20 bp, Artificial sequence
  Synthetic oligonucleotide
attgcctggagtcccgctta

SEQ ID NO: 33 - DNA, 20 bp, Artificial sequence
  Synthetic oligonucleotide
aattgcctggagtcccgctt

SEQ ID NO: 34 - DNA, 20 bp, Artificial sequence
  Synthetic oligonucleotide
taattgcctggagtcccgct

SEQ ID NO: 35 - DNA, 20 bp, Artificial sequence
  Synthetic oligonucleotide
ataattgcctggagtcccgc

SEQ ID NO: 36 - DNA, 20 bp, Artificial sequence
  Synthetic oligonucleotide
aataattgcctggagtcccg

SEQ ID NO: 37 - DNA, 20 bp, Artificial sequence
  Synthetic oligonucleotide
aaataattgcctggagtccc

SEQ ID NO: 38 - DNA, 20 bp, Artificial sequence
  Synthetic oligonucleotide
gaaataattgcctggagtcc

SEQ ID NO: 39 - DNA, 20 bp, Artificial sequence
  Synthetic oligonucleotide
ggaaataattgcctggagtc

SEQ ID NO: 40 - DNA, 20 bp, Artificial sequence
  Synthetic oligonucleotide
tggaaataattgcctggagt

SEQ ID NO: 41 - DNA, 20 bp, Artificial sequence
  Synthetic oligonucleotide
ctggaaataattgcctggag

SEQ ID NO: 42 - DNA, 20 bp, Artificial sequence
  Synthetic oligonucleotide
actggaaataattgcctgga

SEQ ID NO: 43 - DNA, 20 bp, Artificial sequence
  Synthetic oligonucleotide
gactggaaataattgcctgg

SEQ ID NO: 44 - DNA, 20 bp, Artificial sequence
  Synthetic oligonucleotide
tgactggaaataattgcctg

SEQ ID NO: 45 - DNA, 20 bp, Artificial sequence
  Synthetic oligonucleotide
ctgactggaaataattgcct

SEQ ID NO: 46 - DNA, 20 bp, Artificial sequence
  Synthetic oligonucleotide
tctgactggaaataattgcc

SEQ ID NO: 47 - DNA, 20 bp, Artificial sequence
  Synthetic oligonucleotide
ctctgactggaaataattgc

SEQ ID NO: 48 - DNA, 20 bp, Artificial sequence
  Synthetic oligonucleotide
tctctgactggaaataattg

SEQ ID NO: 49 - DNA, 20 bp, Artificial sequence
  Synthetic oligonucleotide
ttctctgactggaaataatt

SEQ ID NO: 50 - DNA, 20 bp, Artificial sequence
  Synthetic oligonucleotide
cttctctgactggaaataat

SEQ ID NO: 51 - DNA, 20 bp, Artificial sequence
  Synthetic oligonucleotide
ccttctctgactggaaataa

SEQ ID NO: 52 - DNA, 20 bp, Artificial sequence
  Synthetic oligonucleotide
tccttctctgactggaaata

SEQ ID NO: 53 - DNA, 20 bp, Artificial sequence
  Synthetic oligonucleotide
ttccttctctgactggaaat

SEQ ID NO: 54 - DNA, 20 bp, Artificial sequence
  Synthetic oligonucleotide
gtttccttctctgactggaa

SEQ ID NO: 55 - DNA, 20 bp, Artificial sequence
  Synthetic oligonucleotide
ggtttccttctctgactgga

SEQ ID NO: 56 - DNA, 20 bp, Artificial sequence
  Synthetic oligonucleotide
tggtttccttctctgactgg

SEQ ID NO: 57 - DNA, 20 bp, Artificial sequence
  Synthetic oligonucleotide
ctggtttccttctctgactg

SEQ ID NO: 58 - DNA, 20 bp, Artificial sequence
  Synthetic oligonucleotide
actggtttccttctctgact

SEQ ID NO: 59 - DNA, 20 bp, Artificial sequence
  Synthetic oligonucleotide
cactggtttccttctctgac

SEQ ID NO: 60 - DNA, 20 bp, Artificial sequence
  Synthetic oligonucleotide
gcactggtttccttctctga

SEQ ID NO: 61 - DNA, 20 bp, Artificial sequence
  Synthetic oligonucleotide
ggcactggtttccttctctg

SEQ ID NO: 62 - DNA, 20 bp, Artificial sequence
  Synthetic oligonucleotide
aggcactggtttccttctct

SEQ ID NO: 63 - DNA, 20 bp, Artificial sequence
  Synthetic oligonucleotide
agatggtgagaatgccaggc

SEQ ID NO: 64 - DNA, 20 bp, Artificial sequence
  Synthetic oligonucleotide
aagatggtgagaatgccagg

SEQ ID NO: 65 - DNA, 20 bp, Artificial sequence
  Synthetic oligonucleotide
aaagatggtgagaatgccag

SEQ ID NO: 66 - DNA, 20 bp, Artificial sequence
  Synthetic oligonucleotide
agaaagatggtgagaatgcc

SEQ ID NO: 67 - DNA, 20 bp, Artificial sequence
  Synthetic oligonucleotide
tagaaagatggtgagaatgc

SEQ ID NO: 68 - DNA, 20 bp, Artificial sequence
  Synthetic oligonucleotide
gtagaaagatggtgagaatg

SEQ ID NO: 69 - DNA, 20 bp, Artificial sequence
  Synthetic oligonucleotide
ggtagaaagatggtgagaat

SEQ ID NO: 70 - DNA, 20 bp, Artificial sequence
  Synthetic oligonucleotide
aggtagaaagatggtgagaa

SEQ ID NO: 71 - DNA, 20 bp, Artificial sequence
  Synthetic oligonucleotide
taggtagaaagatggtgaga

SEQ ID NO: 72 - DNA, 20 bp, Artificial sequence
  Synthetic oligonucleotide
gtaggtagaaagatggtgag

SEQ ID NO: 73 - DNA, 20 bp, Artificial sequence
  Synthetic oligonucleotide
ggtaggtagaaagatggtga

SEQ ID NO: 74 - DNA, 20 bp, Artificial sequence
  Synthetic oligonucleotide
tggtaggtagaaagatggtg

SEQ ID NO: 75 - DNA, 20 bp, Artificial sequence
  Synthetic oligonucleotide
atggtaggtagaaagatggt

SEQ ID NO: 76 - DNA, 20 bp, Artificial sequence
  Synthetic oligonucleotide
catggtaggtagaaagatgg

SEQ ID NO: 77 - DNA, 20 bp, Artificial sequence
  Synthetic oligonucleotide
tcatggtaggtagaaagatg

SEQ ID NO: 78 - DNA, 20 bp, Artificial sequence
  Synthetic oligonucleotide
atcatggtaggtagaaagat

SEQ ID NO: 79 - DNA, 20 bp, Artificial sequence
  Synthetic oligonucleotide
gatcatggtaggtagaaaga

SEQ ID NO: 80 - DNA, 20 bp, Artificial sequence
  Synthetic oligonucleotide
tgatcatggtaggtagaaag

SEQ ID NO: 81 - DNA, 20 bp, Artificial sequence
  Synthetic oligonucleotide
ttgatcatggtaggtagaaa

SEQ ID NO: 82 - DNA, 20 bp, Artificial sequence
  Synthetic oligonucleotide
cttgatcatggtaggtagaa

SEQ ID NO: 83 - DNA, 20 bp, Artificial sequence
  Synthetic oligonucleotide
acttgatcatggtaggtaga

SEQ ID NO: 84 - DNA, 20 bp, Artificial sequence
  Synthetic oligonucleotide
cacttgatcatggtaggtag

SEQ ID NO: 85 - DNA, 20 bp, Artificial sequence
  Synthetic oligonucleotide
gcacttgatcatggtaggta

SEQ ID NO: 86 - DNA, 20 bp, Artificial sequence
  Synthetic oligonucleotide
agcacttgatcatggtaggt

SEQ ID NO: 87 - DNA, 20 bp, Artificial sequence
  Synthetic oligonucleotide
aagcacttgatcatggtagg

SEQ ID NO: 88 - DNA, 20 bp, Artificial sequence
  Synthetic oligonucleotide
acttcaactgacaagcactt

SEQ ID NO: 89 - DNA, 20 bp, Artificial sequence
  Synthetic oligonucleotide
tacttcaactgacaagcact

SEQ ID NO: 90 - DNA, 20 bp, Artificial sequence
  Synthetic oligonucleotide
gtacttcaactgacaagcac

SEQ ID NO: 91 - DNA, 20 bp, Artificial sequence
  Synthetic oligonucleotide
tgtacttcaactgacaagca

SEQ ID NO: 92 - DNA, 20 bp, Artificial sequence
  Synthetic oligonucleotide
ttgtacttcaactgacaagc

SEQ ID NO: 93 - DNA, 20 bp, Artificial sequence
  Synthetic oligonucleotide
gcttgtacttcaactgacaa

SEQ ID NO: 94 - DNA, 20 bp, Artificial sequence
  Synthetic oligonucleotide
ggcttgtacttcaactgaca

SEQ ID NO: 95 - DNA, 20 bp, Artificial sequence
  Synthetic oligonucleotide
tggcttgtacttcaactgac

SEQ ID NO: 96 - DNA, 20 bp, Artificial sequence
  Synthetic oligonucleotide
ttggcttgtacttcaactga

SEQ ID NO: 97 - DNA, 20 bp, Artificial sequence
  Synthetic oligonucleotide
tttggcttgtacttcaactg

SEQ ID NO: 98 - DNA, 20 bp, Artificial sequence
  Synthetic oligonucleotide
atttggcttgtacttcaact

SEQ ID NO: 99 - DNA, 20 bp, Artificial sequence
  Synthetic oligonucleotide
aatttggcttgtacttcaac

SEQ ID NO: 100 - DNA, 20 bp, Artificial sequence
  Synthetic oligonucleotide
caatttggcttgtacttcaa

SEQ ID NO: 101 - DNA, 20 bp, Artificial sequence
  Synthetic oligonucleotide
gcaatttggcttgtacttca

SEQ ID NO: 102 - DNA, 20 bp, Artificial sequence
  Synthetic oligonucleotide
cgcaatttggcttgtacttc

SEQ ID NO: 103 - DNA, 20 bp, Artificial sequence
  Synthetic oligonucleotide
acgcaatttggcttgtactt

SEQ ID NO: 104 - DNA, 20 bp, Artificial sequence
  Synthetic oligonucleotide
aacgcaatttggcttgtact

SEQ ID NO: 105 - DNA, 20 bp, Artificial sequence
  Synthetic oligonucleotide
gaacgcaatttggcttgtac

SEQ ID NO: 106 - DNA, 20 bp, Artificial sequence
  Synthetic oligonucleotide
agaacgcaatttggcttgta

SEQ ID NO: 107 - DNA, 20 bp, Artificial sequence
  Synthetic oligonucleotide
cagaacgcaatttggcttgt

SEQ ID NO: 108 - DNA, 20 bp, Artificial sequence
  Synthetic oligonucleotide
ccagaacgcaatttggcttg

SEQ ID NO: 109 - DNA, 20 bp, Artificial sequence
  Synthetic oligonucleotide
accagaacgcaatttggctt

SEQ ID NO: 110 - DNA, 20 bp, Artificial sequence
  Synthetic oligonucleotide
aaccagaacgcaatttggct

SEQ ID NO: 111 - DNA, 20 bp, Artificial sequence
  Synthetic oligonucleotide
aaaccagaacgcaatttggc

SEQ ID NO: 112 - DNA, 20 bp, Artificial sequence
  Synthetic oligonucleotide
ccaaaccagaacgcaatttg

SEQ ID NO: 113 - DNA, 20 bp, Artificial sequence
  Synthetic oligonucleotide
gccaaaccagaacgcaattt

SEQ ID NO: 114 - DNA, 20 bp, Artificial sequence
  Synthetic oligonucleotide
ttggcccaaggagcttatgg

SEQ ID NO: 115 - DNA, 20 bp, Artificial sequence
  Synthetic oligonucleotide
attggcccaaggagcttatg

SEQ ID NO: 116 - DNA, 20 bp, Artificial sequence
  Synthetic oligonucleotide
cattggcccaaggagcttat

SEQ ID NO: 117 - DNA, 20 bp, Artificial sequence
  Synthetic oligonucleotide
acattggcccaaggagctta

SEQ ID NO: 118 - DNA, 20 bp, Artificial sequence
  Synthetic oligonucleotide
cacattggcccaaggagctt

SEQ ID NO: 119 - DNA, 20 bp, Artificial sequence
  Synthetic oligonucleotide
acacattggcccaaggagct

SEQ ID NO: 120 - DNA, 20 bp, Artificial sequence
  Synthetic oligonucleotide
aacacattggcccaaggagc

SEQ ID NO: 121 - DNA, 20 bp, Artificial sequence
  Synthetic oligonucleotide
caacacattggcccaaggag

SEQ ID NO: 122 - DNA, 20 bp, Artificial sequence
  Synthetic oligonucleotide
tcaacacattggcccaagga

SEQ ID NO: 123 - DNA, 20 bp, Artificial sequence
  Synthetic oligonucleotide
ctcaacacattggcccaagg

SEQ ID NO: 124 - DNA, 20 bp, Artificial sequence
  Synthetic oligonucleotide
cctcaacacattggcccaag

SEQ ID NO: 125 - DNA, 20 bp, Artificial sequence
  Synthetic oligonucleotide
tcctcaacacattggcccaa

SEQ ID NO: 126 - DNA, 20 bp, Artificial sequence
  Synthetic oligonucleotide
ttcctcaacacattggccca

SEQ ID NO: 127 - DNA, 20 bp, Artificial sequence
  Synthetic oligonucleotide
gttcctcaacacattggccc

SEQ ID NO: 128 - DNA, 20 bp, Artificial sequence
  Synthetic oligonucleotide
agttcctcaacacattggcc

SEQ ID NO: 129 - DNA, 20 bp, Artificial sequence
  Synthetic oligonucleotide
aagttcctcaacacattggc

SEQ ID NO: 130 - DNA, 20 bp, Artificial sequence
  Synthetic oligonucleotide
caagttcctcaacacattgg

SEQ ID NO: 131 - DNA, 20 bp, Artificial sequence
  Synthetic oligonucleotide
gcaagttcctcaacacattg

SEQ ID NO: 132 - DNA, 20 bp, Artificial sequence
  Synthetic oligonucleotide
ggcaagttcctcaacacatt

SEQ ID NO: 133 - DNA, 20 bp, Artificial sequence
  Synthetic oligonucleotide
gggcaagttcctcaacacat

SEQ ID NO: 134 - DNA, 20 bp, Artificial sequence
  Synthetic oligonucleotide
agggcaagttcctcaacaca

SEQ ID NO: 135 - DNA, 20 bp, Artificial sequence
  Synthetic oligonucleotide
actgttgagggcaagttcct

SEQ ID NO: 136 - DNA, 20 bp, Artificial sequence
  Synthetic oligonucleotide
tactgttgagggcaagttcc

SEQ ID NO: 137 - DNA, 20 bp, Artificial sequence
  Synthetic oligonucleotide
atactgttgagggcaagttc

SEQ ID NO: 138 - DNA, 20 bp, Artificial sequence
  Synthetic oligonucleotide
aatactgttgagggcaagtt

SEQ ID NO: 139 - DNA, 20 bp, Artificial sequence
  Synthetic oligonucleotide
caatactgttgagggcaagt

SEQ ID NO: 140 - DNA, 20 bp, Artificial sequence
  Synthetic oligonucleotide
tcaatactgttgagggcaag

SEQ ID NO: 141 - DNA, 20 bp, Artificial sequence
  Synthetic oligonucleotide
atcaatactgttgagggcaa

SEQ ID NO: 142 - DNA, 20 bp, Artificial sequence
  Synthetic oligonucleotide
catcaatactgttgagggca

SEQ ID NO: 143 - DNA, 20 bp, Artificial sequence
  Synthetic oligonucleotide
gcatcaatactgttgagggc

SEQ ID NO: 144 - DNA, 20 bp, Artificial sequence
  Synthetic oligonucleotide
agcatcaatactgttgaggg

SEQ ID NO: 145 - DNA, 20 bp, Artificial sequence
  Synthetic oligonucleotide
cagcatcaatactgttgagg

SEQ ID NO: 146 - DNA, 20 bp, Artificial sequence
  Synthetic oligonucleotide
tcagcatcaatactgttgag

SEQ ID NO: 147 - DNA, 20 bp, Artificial sequence
  Synthetic oligonucleotide
ttcagcatcaatactgttga

SEQ ID NO: 148 - DNA, 20 bp, Artificial sequence
  Synthetic oligonucleotide
cttcagcatcaatactgttg

SEQ ID NO: 149 - DNA, 20 bp, Artificial sequence
  Synthetic oligonucleotide
agccacacattttgcttcag

SEQ ID NO: 150 - DNA, 20 bp, Artificial sequence
  Synthetic oligonucleotide
cagccacacattttgcttca

SEQ ID NO: 151 - DNA, 20 bp, Artificial sequence
  Synthetic oligonucleotide
acagccacacattttgcttc

SEQ ID NO: 152 - DNA, 20 bp, Artificial sequence
  Synthetic oligonucleotide
gacagccacacattttgctt

SEQ ID NO: 153 - DNA, 20 bp, Artificial sequence
  Synthetic oligonucleotide
tgacagccacacattttgct

SEQ ID NO: 154 - DNA, 20 bp, Artificial sequence
  Synthetic oligonucleotide
ctgacagccacacattttgc

SEQ ID NO: 155 - DNA, 20 bp, Artificial sequence
  Synthetic oligonucleotide
cctgacagccacacattttg

SEQ ID NO: 156 - DNA, 20 bp, Artificial sequence
  Synthetic oligonucleotide
ccctgacagccacacatttt

SEQ ID NO: 157 - DNA, 20 bp, Artificial sequence
  Synthetic oligonucleotide
accctgacagccacacattt

SEQ ID NO: 158 - DNA, 20 bp, Artificial sequence
  Synthetic oligonucleotide
caccctgacagccacacatt

SEQ ID NO: 159 - DNA, 20 bp, Artificial sequence
  Synthetic oligonucleotide
tcaccctgacagccacacat

SEQ ID NO: 160 - DNA, 20 bp, Artificial sequence
  Synthetic oligonucleotide
ttcaccctgacagccacaca

SEQ ID NO: 161 - DNA, 20 bp, Artificial sequence
  Synthetic oligonucleotide
attcaccctgacagccacac

SEQ ID NO: 162 - DNA, 20 bp, Artificial sequence
  Synthetic oligonucleotide
tattcaccctgacagccaca

SEQ ID NO: 163 - DNA, 20 bp, Artificial sequence
  Synthetic oligonucleotide
atattcaccctgacagccac

SEQ ID NO: 164 - DNA, 20 bp, Artificial sequence
  Synthetic oligonucleotide
catattcaccctgacagcca

SEQ ID NO: 165 - DNA, 20 bp, Artificial sequence
  Synthetic oligonucleotide
ccatattcaccctgacagcc

SEQ ID NO: 166 - DNA, 20 bp, Artificial sequence
  Synthetic oligonucleotide
tccatattcaccctgacagc

SEQ ID NO: 167 - DNA, 20 bp, Artificial sequence
  Synthetic oligonucleotide
ttccatattcaccctgacag

SEQ ID NO: 168 - DNA, 20 bp, Artificial sequence
  Synthetic oligonucleotide
tttccatattcaccctgaca

SEQ ID NO: 169 - DNA, 20 bp, Artificial sequence
  Synthetic oligonucleotide
gtttccatattcaccctgac

SEQ ID NO: 170 - DNA, 20 bp, Artificial sequence
  Synthetic oligonucleotide
ggtttccatattcaccctga

SEQ ID NO: 171 - DNA, 20 bp, Artificial sequence
  Synthetic oligonucleotide
aggtttccatattcaccctg

SEQ ID NO: 172 - DNA, 20 bp, Artificial sequence
  Synthetic oligonucleotide
aaggtttccatattcaccct

SEQ ID NO: 173 - DNA, 20 bp, Artificial sequence
  Synthetic oligonucleotide
gaaggtttccatattcaccc

SEQ ID NO: 174 - DNA, 20 bp, Artificial sequence
  Synthetic oligonucleotide
acttgaacttggaaggtttc

SEQ ID NO: 175 - DNA, 20 bp, Artificial sequence
  Synthetic oligonucleotide
cacttgaacttggaaggttt

SEQ ID NO: 176 - DNA, 20 bp, Artificial sequence
  Synthetic oligonucleotide
tcacttgaacttggaaggtt

SEQ ID NO: 177 - DNA, 20 bp, Artificial sequence
  Synthetic oligonucleotide
atcacttgaacttggaaggt

SEQ ID NO: 178 - DNA, 20 bp, Artificial sequence
  Synthetic oligonucleotide
tatcacttgaacttggaagg

SEQ ID NO: 179 - DNA, 20 bp, Artificial sequence
  Synthetic oligonucleotide
ctatcacttgaacttggaag

SEQ ID NO: 180 - DNA, 20 bp, Artificial sequence
  Synthetic oligonucleotide
tctatcacttgaacttggaa

SEQ ID NO: 181 - DNA, 20 bp, Artificial sequence
  Synthetic oligonucleotide
gtctatcacttgaacttgga

SEQ ID NO: 182 - DNA, 20 bp, Artificial sequence
  Synthetic oligonucleotide
tgtctatcacttgaacttgg

SEQ ID NO: 183 - DNA, 20 bp, Artificial sequence
  Synthetic oligonucleotide
ttgtctatcacttgaacttg

SEQ ID NO: 184 - DNA, 20 bp, Artificial sequence
  Synthetic oligonucleotide
attgtctatcacttgaactt

SEQ ID NO: 185 - DNA, 20 bp, Artificial sequence
  Synthetic oligonucleotide
cattgtctatcacttgaact

SEQ ID NO: 186 - DNA, 20 bp, Artificial sequence
  Synthetic oligonucleotide
ccattgtctatcacttgaac

SEQ ID NO: 187 - DNA, 20 bp, Artificial sequence
  Synthetic oligonucleotide
tccattgtctatcacttgaa

SEQ ID NO: 188 - DNA, 20 bp, Artificial sequence
  Synthetic oligonucleotide
atccattgtctatcacttga

SEQ ID NO: 189 - DNA, 20 bp, Artificial sequence
  Synthetic oligonucleotide
aatccattgtctatcacttg

SEQ ID NO: 190 - DNA, 20 bp, Artificial sequence
  Synthetic oligonucleotide
aaatccattgtctatcactt

SEQ ID NO: 191 - DNA, 20 bp, Artificial sequence
  Synthetic oligonucleotide
caaatccattgtctatcact

SEQ ID NO: 192 - DNA, 20 bp, Artificial sequence
  Synthetic oligonucleotide
ccaaatccattgtctatcac

SEQ ID NO: 193 - DNA, 20 bp, Artificial sequence
  Synthetic oligonucleotide
cccaaatccattgtctatca

SEQ ID NO: 194 - DNA, 20 bp, Artificial sequence
  Synthetic oligonucleotide
tcccaaatccattgtctatc

SEQ ID NO: 195 - DNA, 20 bp, Artificial sequence
  Synthetic oligonucleotide
atcccaaatccattgtctat

SEQ ID NO: 196 - DNA, 20 bp, Artificial sequence
  Synthetic oligonucleotide
catcccaaatccattgtcta

SEQ ID NO: 197 - DNA, 20 bp, Artificial sequence
  Synthetic oligonucleotide
ccatcccaaatccattgtct

SEQ ID NO: 198 - DNA, 20 bp, Artificial sequence
  Synthetic oligonucleotide
cccatcccaaatccattgtc

SEQ ID NO: 199 - DNA, 20 bp, Artificial sequence
  Synthetic oligonucleotide
ccccatcccaaatccattgt

SEQ ID NO: 200 - DNA, 20 bp, Artificial sequence
  Synthetic oligonucleotide
ctccccatcccaaatccatt

SEQ ID NO: 201 - DNA, 20 bp, Artificial sequence
  Synthetic oligonucleotide
actccccatcccaaatccat

SEQ ID NO: 202 - DNA, 20 bp, Artificial sequence
  Synthetic oligonucleotide
cactccccatcccaaatcca

SEQ ID NO: 203 - DNA, 20 bp, Artificial sequence
  Synthetic oligonucleotide
tcactccccatcccaaatcc

SEQ ID NO: 204 - DNA, 20 bp, Artificial sequence
  Synthetic oligonucleotide
atcactccccatcccaaatc

SEQ ID NO: 205 - DNA, 20 bp, Artificial sequence
  Synthetic oligonucleotide
catcactccccatcccaaat

SEQ ID NO: 206 - DNA, 20 bp, Artificial sequence
  Synthetic oligonucleotide
tcatcactccccatcccaaa

SEQ ID NO: 207 - DNA, 20 bp, Artificial sequence
  Synthetic oligonucleotide
atcatcactccccatcccaa

SEQ ID NO: 208 - DNA, 20 bp, Artificial sequence
  Synthetic oligonucleotide
catcatcactccccatccca

SEQ ID NO: 209 - DNA, 20 bp, Artificial sequence
  Synthetic oligonucleotide
acatcatcactccccatccc

SEQ ID NO: 210 - DNA, 20 bp, Artificial sequence
  Synthetic oligonucleotide
tacatcatcactccccatcc

SEQ ID NO: 211 - DNA, 20 bp, Artificial sequence
  Synthetic oligonucleotide
ctacatcatcactccccatc

SEQ ID NO: 212 - DNA, 20 bp, Artificial sequence
  Synthetic oligonucleotide
tctacatcatcactccccat

SEQ ID NO: 213 - DNA, 20 bp, Artificial sequence
  Synthetic oligonucleotide
ctctacatcatcactcccca

SEQ ID NO: 214 - DNA, 20 bp, Artificial sequence
  Synthetic oligonucleotide
tctctacatcatcactcccc

SEQ ID NO: 215 - DNA, 20 bp, Artificial sequence
  Synthetic oligonucleotide
ttctctacatcatcactccc

SEQ ID NO: 216 - DNA, 20 bp, Artificial sequence
  Synthetic oligonucleotide
tttctctacatcatcactcc

SEQ ID NO: 217 - DNA, 20 bp, Artificial sequence
  Synthetic oligonucleotide
ctttctctacatcatcactc

SEQ ID NO: 218 - DNA, 20 bp, Artificial sequence
  Synthetic oligonucleotide
actttctctacatcatcact

SEQ ID NO: 219 - DNA, 20 bp, Artificial sequence
  Synthetic oligonucleotide
cactttctctacatcatcac

SEQ ID NO: 220 - DNA, 20 bp, Artificial sequence
  Synthetic oligonucleotide
ccactttctctacatcatca

SEQ ID NO: 221 - DNA, 20 bp, Artificial sequence
  Synthetic oligonucleotide
cccactttctctacatcatc

SEQ ID NO: 222 - DNA, 20 bp, Artificial sequence
  Synthetic oligonucleotide
tcccactttctctacatcat

SEQ ID NO: 223 - DNA, 20 bp, Artificial sequence
  Synthetic oligonucleotide
ttcccactttctctacatca

SEQ ID NO: 224 - DNA, 20 bp, Artificial sequence
  Synthetic oligonucleotide
tttcccactttctctacatc

SEQ ID NO: 225 - DNA, 20 bp, Artificial sequence
  Synthetic oligonucleotide
atttcccactttctctacat

SEQ ID NO: 226 - DNA, 20 bp, Artificial sequence
  Synthetic oligonucleotide
gatttcccactttctctaca

SEQ ID NO: 227 - DNA, 20 bp, Artificial sequence
  Synthetic oligonucleotide
cgatttcccactttctctac

SEQ ID NO: 228 - DNA, 20 bp, Artificial sequence
  Synthetic oligonucleotide
acgatttcccactttctcta

SEQ ID NO: 229 - DNA, 20 bp, Artificial sequence
  Synthetic oligonucleotide
aacgatttcccactttctct

SEQ ID NO: 230 - DNA, 20 bp, Artificial sequence
  Synthetic oligonucleotide
taacgatttcccactttctc

SEQ ID NO: 231 - DNA, 20 bp, Artificial sequence
  Synthetic oligonucleotide
ataacgatttcccactttct

SEQ ID NO: 232 - DNA, 20 bp, Artificial sequence
  Synthetic oligonucleotide
aataacgatttcccactttc

SEQ ID NO: 233 - DNA, 20 bp, Artificial sequence
  Synthetic oligonucleotide
aaataacgatttcccacttt

SEQ ID NO: 234 - DNA, 20 bp, Artificial sequence
  Synthetic oligonucleotide
tactggtgaaataacgattt

SEQ ID NO: 235 - DNA, 20 bp, Artificial sequence
  Synthetic oligonucleotide
ttactggtgaaataacgatt

SEQ ID NO: 236 - DNA, 20 bp, Artificial sequence
  Synthetic oligonucleotide
tttactggtgaaataacgat

SEQ ID NO: 237 - DNA, 20 bp, Artificial sequence
  Synthetic oligonucleotide
atttactggtgaaataacga

SEQ ID NO: 238 - DNA, 20 bp, Artificial sequence
  Synthetic oligonucleotide
catttactggtgaaataacg

SEQ ID NO: 239 - DNA, 20 bp, Artificial sequence
  Synthetic oligonucleotide
gcatttactggtgaaataac

SEQ ID NO: 240 - DNA, 20 bp, Artificial sequence
  Synthetic oligonucleotide
ggcatttactggtgaaataa

SEQ ID NO: 241 - DNA, 20 bp, Artificial sequence
  Synthetic oligonucleotide
tggcatttactggtgaaata

SEQ ID NO: 242 - DNA, 20 bp, Artificial sequence
  Synthetic oligonucleotide
gtggcatttactggtgaaat

SEQ ID NO: 243 - DNA, 20 bp, Artificial sequence
  Synthetic oligonucleotide
agtggcatttactggtgaaa

SEQ ID NO: 244 - DNA, 20 bp, Artificial sequence
  Synthetic oligonucleotide
gagtggcatttactggtgaa

SEQ ID NO: 245 - DNA, 20 bp, Artificial sequence
  Synthetic oligonucleotide
cgagtggcatttactggtga

SEQ ID NO: 246 - DNA, 20 bp, Artificial sequence
  Synthetic oligonucleotide
ccgagtggcatttactggtg

SEQ ID NO: 247 - DNA, 20 bp, Artificial sequence
  Synthetic oligonucleotide
tccaagtcctgtaccgagtg

SEQ ID NO: 248 - DNA, 20 bp, Artificial sequence
  Synthetic oligonucleotide
ctccaagtcctgtaccgagt

SEQ ID NO: 249 - DNA, 20 bp, Artificial sequence
  Synthetic oligonucleotide
tctccaagtcctgtaccgag

SEQ ID NO: 250 - DNA, 20 bp, Artificial sequence
  Synthetic oligonucleotide
ttctccaagtcctgtaccga

SEQ ID NO: 251 - DNA, 20 bp, Artificial sequence
  Synthetic oligonucleotide
attctccaagtcctgtaccg

SEQ ID NO: 252 - DNA, 20 bp, Artificial sequence
  Synthetic oligonucleotide
gattctccaagtcctgtacc

SEQ ID NO: 253 - DNA, 20 bp, Artificial sequence
  Synthetic oligonucleotide
ggattctccaagtcctgtac

SEQ ID NO: 254 - DNA, 20 bp, Artificial sequence
  Synthetic oligonucleotide
cataaaaccttggattctcc

SEQ ID NO: 255 - DNA, 20 bp, Artificial sequence
  Synthetic oligonucleotide
ccataaaaccttggattctc

SEQ ID NO: 256 - DNA, 20 bp, Artificial sequence
  Synthetic oligonucleotide
accataaaaccttggattct

SEQ ID NO: 257 - DNA, 20 bp, Artificial sequence
  Synthetic oligonucleotide
aaccataaaaccttggattc

SEQ ID NO: 258 - DNA, 20 bp, Artificial sequence
  Synthetic oligonucleotide
aaaccataaaaccttggatt

SEQ ID NO: 259 - DNA, 20 bp, Artificial sequence
  Synthetic oligonucleotide
gaaaccataaaaccttggat

SEQ ID NO: 260 - DNA, 20 bp, Artificial sequence
  Synthetic oligonucleotide
ggaaaccataaaaccttgga

SEQ ID NO: 261 - DNA, 20 bp, Artificial sequence
  Synthetic oligonucleotide
tcggaaaccataaaaccttg

SEQ ID NO: 262 - DNA, 20 bp, Artificial sequence
  Synthetic oligonucleotide
ctcggaaaccataaaacctt

SEQ ID NO: 263 - DNA, 20 bp, Artificial sequence
  Synthetic oligonucleotide
cctcggaaaccataaaacct

SEQ ID NO: 264 - DNA, 20 bp, Artificial sequence
  Synthetic oligonucleotide
tcctcggaaaccataaaacc

SEQ ID NO: 265 - DNA, 20 bp, Artificial sequence
  Synthetic oligonucleotide
ctcctcggaaaccataaaac

SEQ ID NO: 266 - DNA, 20 bp, Artificial sequence
  Synthetic oligonucleotide
tctcctcggaaaccataaaa

SEQ ID NO: 267 - DNA, 20 bp, Artificial sequence
  Synthetic oligonucleotide
ctctcctcggaaaccataaa

SEQ ID NO: 268 - DNA, 20 bp, Artificial sequence
  Synthetic oligonucleotide
cctctcctcggaaaccataa

SEQ ID NO: 269 - DNA, 20 bp, Artificial sequence
  Synthetic oligonucleotide
gcctctcctcggaaaccata

SEQ ID NO: 270 - DNA, 20 bp, Artificial sequence
  Synthetic oligonucleotide
ggccatgtcagcaatatttg

SEQ ID NO: 271 - DNA, 20 bp, Artificial sequence
  Synthetic oligonucleotide
tggccatgtcagcaatattt

SEQ ID NO: 272 - DNA, 20 bp, Artificial sequence
  Synthetic oligonucleotide
ctggccatgtcagcaatatt

SEQ ID NO: 273 - DNA, 20 bp, Artificial sequence
  Synthetic oligonucleotide
actggccatgtcagcaatat

SEQ ID NO: 274 - DNA, 20 bp, Artificial sequence
  Synthetic oligonucleotide
cactggccatgtcagcaata

SEQ ID NO: 275 - DNA, 20 bp, Artificial sequence
  Synthetic oligonucleotide
gcactggccatgtcagcaat

SEQ ID NO: 276 - DNA, 20 bp, Artificial sequence
  Synthetic oligonucleotide
agcactggccatgtcagcaa

SEQ ID NO: 277 - DNA, 20 bp, Artificial sequence
  Synthetic oligonucleotide
cgaaatttccacagcactgg

SEQ ID NO: 278 - DNA, 20 bp, Artificial sequence
  Synthetic oligonucleotide
acgaaatttccacagcactg

SEQ ID NO: 279 - DNA, 20 bp, Artificial sequence
  Synthetic oligonucleotide
gacgaaatttccacagcact

SEQ ID NO: 280 - DNA, 20 bp, Artificial sequence
  Synthetic oligonucleotide
ggacgaaatttccacagcac

SEQ ID NO: 281 - DNA, 20 bp, Artificial sequence
  Synthetic oligonucleotide
tggacgaaatttccacagca

SEQ ID NO: 282 - DNA, 20 bp, Artificial sequence
  Synthetic oligonucleotide
ttttcttggacgaaatttcc

SEQ ID NO: 283 - DNA, 20 bp, Artificial sequence
  Synthetic oligonucleotide
tttttcttggacgaaatttc

SEQ ID NO: 284 - DNA, 20 bp, Artificial sequence
  Synthetic oligonucleotide
gtttttcttggacgaaattt

SEQ ID NO: 285 - DNA, 20 bp, Artificial sequence
  Synthetic oligonucleotide
tgtttttcttggacgaaatt

SEQ ID NO: 286 - DNA, 20 bp, Artificial sequence
  Synthetic oligonucleotide
ctgtttttcttggacgaaat

SEQ ID NO: 287 - DNA, 20 bp, Artificial sequence
  Synthetic oligonucleotide
cctgtttttcttggacgaaa

SEQ ID NO: 288 - DNA, 20 bp, Artificial sequence
  Synthetic oligonucleotide
tcctgtttttcttggacgaa

SEQ ID NO: 289 - DNA, 20 bp, Artificial sequence
  Synthetic oligonucleotide
attgtcctgtttttcttgga

SEQ ID NO: 290 - DNA, 20 bp, Artificial sequence
  Synthetic oligonucleotide
cattgtcctgtttttcttgg

SEQ ID NO: 291 - DNA, 20 bp, Artificial sequence
  Synthetic oligonucleotide
tcattgtcctgtttttcttg

SEQ ID NO: 292 - DNA, 20 bp, Artificial sequence
  Synthetic oligonucleotide
ttcattgtcctgtttttctt

SEQ ID NO: 293 - DNA, 20 bp, Artificial sequence
  Synthetic oligonucleotide
tttcattgtcctgtttttct

SEQ ID NO: 294 - DNA, 20 bp, Artificial sequence
  Synthetic oligonucleotide
ttttcattgtcctgtttttc

SEQ ID NO: 295 - DNA, 20 bp, Artificial sequence
  Synthetic oligonucleotide
gttttcattgtcctgttttt

SEQ ID NO: 296 - DNA, 20 bp, Artificial sequence
  Synthetic oligonucleotide
agttttcattgtcctgtttt

SEQ ID NO: 297 - DNA, 20 bp, Artificial sequence
  Synthetic oligonucleotide
aagttttcattgtcctgttt

SEQ ID NO: 298 - DNA, 20 bp, Artificial sequence
  Synthetic oligonucleotide
aaagttttcattgtcctgtt

SEQ ID NO: 299 - DNA, 20 bp, Artificial sequence
  Synthetic oligonucleotide
aaaagttttcattgtcctgt

SEQ ID NO: 300 - DNA, 20 bp, Artificial sequence
  Synthetic oligonucleotide
caaaagttttcattgtcctg

SEQ ID NO: 301 - DNA, 20 bp, Artificial sequence
  Synthetic oligonucleotide
acaaaagttttcattgtcct

SEQ ID NO: 302 - DNA, 20 bp, Artificial sequence
  Synthetic oligonucleotide
cacaaaagttttcattgtcc

SEQ ID NO: 303 - DNA, 20 bp, Artificial sequence
  Synthetic oligonucleotide
tcacaaaagttttcattgtc

SEQ ID NO: 304 - DNA, 20 bp, Artificial sequence
  Synthetic oligonucleotide
ttcacaaaagttttcattgt

SEQ ID NO: 305 - DNA, 20 bp, Artificial sequence
  Synthetic oligonucleotide
tttcacaaaagttttcattg

SEQ ID NO: 306 - DNA, 20 bp, Artificial sequence
  Synthetic oligonucleotide
gtttcacaaaagttttcatt

SEQ ID NO: 307 - DNA, 20 bp, Artificial sequence
  Synthetic oligonucleotide
agtttcacaaaagttttcat

SEQ ID NO: 308 - DNA, 20 bp, Artificial sequence
  Synthetic oligonucleotide
cagtttcacaaaagttttca

SEQ ID NO: 309 - DNA, 20 bp, Artificial sequence
  Synthetic oligonucleotide
acagtttcacaaaagttttc

SEQ ID NO: 310 - DNA, 20 bp, Artificial sequence
  Synthetic oligonucleotide
aacagtttcacaaaagtttt

SEQ ID NO: 311 - DNA, 20 bp, Artificial sequence
  Synthetic oligonucleotide
aaacagtttcacaaaagttt

SEQ ID NO: 312 - DNA, 20 bp, Artificial sequence
  Synthetic oligonucleotide
tttccactctgaaacagttt

SEQ ID NO: 313 - DNA, 20 bp, Artificial sequence
  Synthetic oligonucleotide
ttttccactctgaaacagtt

SEQ ID NO: 314 - DNA, 20 bp, Artificial sequence
  Synthetic oligonucleotide
cttttccactctgaaacagt

SEQ ID NO: 315 - DNA, 20 bp, Artificial sequence
  Synthetic oligonucleotide
gcttttccactctgaaacag

SEQ ID NO: 316 - DNA, 20 bp, Artificial sequence
  Synthetic oligonucleotide
ggcttttccactctgaaaca

SEQ ID NO: 317 - DNA, 20 bp, Artificial sequence
  Synthetic oligonucleotide
gggcttttccactctgaaac

SEQ ID NO: 318 - DNA, 20 bp, Artificial sequence
  Synthetic oligonucleotide
agggcttttccactctgaaa

SEQ ID NO: 319 - DNA, 20 bp, Artificial sequence
  Synthetic oligonucleotide
cagggcttttccactctgaa

SEQ ID NO: 320 - DNA, 20 bp, Artificial sequence
  Synthetic oligonucleotide
tcagggcttttccactctga

SEQ ID NO: 321 - DNA, 20 bp, Artificial sequence
  Synthetic oligonucleotide
ttcagggcttttccactctg

SEQ ID NO: 322 - DNA, 20 bp, Artificial sequence
  Synthetic oligonucleotide
tttcagggcttttccactct

SEQ ID NO: 323 - DNA, 20 bp, Artificial sequence
  Synthetic oligonucleotide
ctttcagggcttttccactc

SEQ ID NO: 324 - DNA, 20 bp, Artificial sequence
  Synthetic oligonucleotide
gctttcagggcttttccact

SEQ ID NO: 325 - DNA, 20 bp, Artificial sequence
  Synthetic oligonucleotide
agctttcagggcttttccac

SEQ ID NO: 326 - DNA, 20 bp, Artificial sequence
  Synthetic oligonucleotide
agtcacatcagcttcacaag

SEQ ID NO: 327 - DNA, 20 bp, Artificial sequence
  Synthetic oligonucleotide
tagtcacatcagcttcacaa

SEQ ID NO: 328 - DNA, 20 bp, Artificial sequence
  Synthetic oligonucleotide
ctagtcacatcagcttcaca

SEQ ID NO: 329 - DNA, 20 bp, Artificial sequence
  Synthetic oligonucleotide
tctagtcacatcagcttcac

SEQ ID NO: 330 - DNA, 20 bp, Artificial sequence
  Synthetic oligonucleotide
ctctagtcacatcagcttca

SEQ ID NO: 331 - DNA, 20 bp, Artificial sequence
  Synthetic oligonucleotide
gctctagtcacatcagcttc

SEQ ID NO: 332 - DNA, 20 bp, Artificial sequence
  Synthetic oligonucleotide
tgctctagtcacatcagctt

SEQ ID NO: 333 - DNA, 20 bp, Artificial sequence
  Synthetic oligonucleotide
ttgctctagtcacatcagct

SEQ ID NO: 334 - DNA, 20 bp, Artificial sequence
  Synthetic oligonucleotide
cttgctctagtcacatcagc

SEQ ID NO: 335 - DNA, 20 bp, Artificial sequence
  Synthetic oligonucleotide
gcttgctctagtcacatcag

SEQ ID NO: 336 - DNA, 20 bp, Artificial sequence
  Synthetic oligonucleotide
cgcttgctctagtcacatca

SEQ ID NO: 337 - DNA, 20 bp, Artificial sequence
  Synthetic oligonucleotide
gcgcttgctctagtcacatc

SEQ ID NO: 338 - DNA, 20 bp, Artificial sequence
  Synthetic oligonucleotide
tacagtagtcccagcgcttg

SEQ ID NO: 339 - DNA, 20 bp, Artificial sequence
  Synthetic oligonucleotide
ttacagtagtcccagcgctt

SEQ ID NO: 340 - DNA, 20 bp, Artificial sequence
  Synthetic oligonucleotide
gttacagtagtcccagcgct

SEQ ID NO: 341 - DNA, 20 bp, Artificial sequence
  Synthetic oligonucleotide
tgttacagtagtcccagcgc

SEQ ID NO: 342 - DNA, 20 bp, Artificial sequence
  Synthetic oligonucleotide
ctgttacagtagtcccagcg

SEQ ID NO: 343 - DNA, 20 bp, Artificial sequence
  Synthetic oligonucleotide
ataggttatacactgttaca

SEQ ID NO: 344 - DNA, 20 bp, Artificial sequence
  Synthetic oligonucleotide
aataggttatacactgttac

SEQ ID NO: 345 - DNA, 20 bp, Artificial sequence
  Synthetic oligonucleotide
aaataggttatacactgtta

SEQ ID NO: 346 - DNA, 20 bp, Artificial sequence
  Synthetic oligonucleotide
aaaataggttatacactgtt

SEQ ID NO: 347 - DNA, 20 bp, Artificial sequence
  Synthetic oligonucleotide
taaaataggttatacactgt

SEQ ID NO: 348 - DNA, 20 bp, Artificial sequence
  Synthetic oligonucleotide
gtaaaataggttatacactg

SEQ ID NO: 349 - DNA, 20 bp, Artificial sequence
  Synthetic oligonucleotide
ggtaaaataggttatacact

SEQ ID NO: 350 - DNA, 20 bp, Artificial sequence
  Synthetic oligonucleotide
tggtaaaataggttatacac

SEQ ID NO: 351 - DNA, 20 bp, Artificial sequence
  Synthetic oligonucleotide
ctggtaaaataggttataca

SEQ ID NO: 352 - DNA, 20 bp, Artificial sequence
  Synthetic oligonucleotide
gctggtaaaataggttatac

SEQ ID NO: 353 - DNA, 20 bp, Artificial sequence
  Synthetic oligonucleotide
agctggtaaaataggttata

SEQ ID NO: 354 - DNA, 20 bp, Artificial sequence
  Synthetic oligonucleotide
aagctggtaaaataggttat

SEQ ID NO: 355 - DNA, 20 bp, Artificial sequence
  Synthetic oligonucleotide
gaagctggtaaaataggtta

SEQ ID NO: 356 - DNA, 20 bp, Artificial sequence
  Synthetic oligonucleotide
ggaagctggtaaaataggtt

SEQ ID NO: 357 - DNA, 20 bp, Artificial sequence
  Synthetic oligonucleotide
aggaagctggtaaaataggt

SEQ ID NO: 358 - DNA, 20 bp, Artificial sequence
  Synthetic oligonucleotide
caggaagctggtaaaatagg

SEQ ID NO: 359 - DNA, 20 bp, Artificial sequence
  Synthetic oligonucleotide
acaggaagctggtaaaatag

SEQ ID NO: 360 - DNA, 20 bp, Artificial sequence
  Synthetic oligonucleotide
tacaggaagctggtaaaata

SEQ ID NO: 361 - DNA, 20 bp, Artificial sequence
  Synthetic oligonucleotide
ttacaggaagctggtaaaat

SEQ ID NO: 362 - DNA, 20 bp, Artificial sequence
  Synthetic oligonucleotide
cttacaggaagctggtaaaa

SEQ ID NO: 363 - DNA, 20 bp, Artificial sequence
  Synthetic oligonucleotide
ccttacaggaagctggtaaa

SEQ ID NO: 364 - DNA, 20 bp, Artificial sequence
  Synthetic oligonucleotide
atgcatttcctccttacagg

SEQ ID NO: 365 - DNA, 20 bp, Artificial sequence
  Synthetic oligonucleotide
catgcatttcctccttacag

SEQ ID NO: 366 - DNA, 20 bp, Artificial sequence
  Synthetic oligonucleotide
ccatgcatttcctccttaca

SEQ ID NO: 367 - DNA, 20 bp, Artificial sequence
  Synthetic oligonucleotide
tccatgcatttcctccttac

SEQ ID NO: 368 - DNA, 20 bp, Artificial sequence
  Synthetic oligonucleotide
gtccatgcatttcctcctta

SEQ ID NO: 369 - DNA, 20 bp, Artificial sequence
  Synthetic oligonucleotide
ggtccatgcatttcctcctt

SEQ ID NO: 370 - DNA, 20 bp, Artificial sequence
  Synthetic oligonucleotide
gggtccatgcatttcctcct

SEQ ID NO: 371 - DNA, 20 bp, Artificial sequence
  Synthetic oligonucleotide
agggtccatgcatttcctcc

SEQ ID NO: 372 - DNA, 20 bp, Artificial sequence
  Synthetic oligonucleotide
tagggtccatgcatttcctc

SEQ ID NO: 373 - DNA, 20 bp, Artificial sequence
  Synthetic oligonucleotide
ctagggtccatgcatttcct

SEQ ID NO: 374 - DNA, 20 bp, Artificial sequence
  Synthetic oligonucleotide
tctagggtccatgcatttcc

SEQ ID NO: 375 - DNA, 20 bp, Artificial sequence
  Synthetic oligonucleotide
gtctagggtccatgcatttc

SEQ ID NO: 376 - DNA, 20 bp, Artificial sequence
  Synthetic oligonucleotide
agtctagggtccatgcattt

SEQ ID NO: 377 - DNA, 20 bp, Artificial sequence
  Synthetic oligonucleotide
cagtctagggtccatgcatt

SEQ ID NO: 378 - DNA, 20 bp, Artificial sequence
  Synthetic oligonucleotide
ccagtctagggtccatgcat

SEQ ID NO: 379 - DNA, 20 bp, Artificial sequence
  Synthetic oligonucleotide
tccagtctagggtccatgca

SEQ ID NO: 380 - DNA, 20 bp, Artificial sequence
  Synthetic oligonucleotide
actccagtctagggtccatg

SEQ ID NO: 381 - DNA, 20 bp, Artificial sequence
  Synthetic oligonucleotide
aactccagtctagggtccat

SEQ ID NO: 382 - DNA, 20 bp, Artificial sequence
  Synthetic oligonucleotide
aaactccagtctagggtcca

SEQ ID NO: 383 - DNA, 20 bp, Artificial sequence
  Synthetic oligonucleotide
caaactccagtctagggtcc

SEQ ID NO: 384 - DNA, 20 bp, Artificial sequence
  Synthetic oligonucleotide
tcaaactccagtctagggtc

SEQ ID NO: 385 - DNA, 20 bp, Artificial sequence
  Synthetic oligonucleotide
ctcaaactccagtctagggt

SEQ ID NO: 386 - DNA, 20 bp, Artificial sequence
  Synthetic oligonucleotide
tctcaaactccagtctaggg

SEQ ID NO: 387 - DNA, 20 bp, Artificial sequence
  Synthetic oligonucleotide
ttctcaaactccagtctagg

SEQ ID NO: 388 - DNA, 20 bp, Artificial sequence
  Synthetic oligonucleotide
cttctcaaactccagtctag

SEQ ID NO: 389 - DNA, 20 bp, Artificial sequence
  Synthetic oligonucleotide
ccttctcaaactccagtcta

SEQ ID NO: 390 - DNA, 20 bp, Artificial sequence
  Synthetic oligonucleotide
accttctcaaactccagtct

SEQ ID NO: 391 - DNA, 20 bp, Artificial sequence
  Synthetic oligonucleotide
aaccttctcaaactccagtc

SEQ ID NO: 392 - DNA, 20 bp, Artificial sequence
  Synthetic oligonucleotide
taaccttctcaaactccagt

SEQ ID NO: 393 - DNA, 20 bp, Artificial sequence
  Synthetic oligonucleotide
ctaaccttctcaaactccag

SEQ ID NO: 394 - DNA, 20 bp, Artificial sequence
  Synthetic oligonucleotide
cctaaccttctcaaactcca

SEQ ID NO: 395 - DNA, 20 bp, Artificial sequence
  Synthetic oligonucleotide
gcctaaccttctcaaactcc

SEQ ID NO: 396 - DNA, 20 bp, Artificial sequence
  Synthetic oligonucleotide
tgcctaaccttctcaaactc

SEQ ID NO: 397 - DNA, 20 bp, Artificial sequence
  Synthetic oligonucleotide
ctgcctaaccttctcaaact

SEQ ID NO: 398 - DNA, 20 bp, Artificial sequence
  Synthetic oligonucleotide
tctgcctaaccttctcaaac

SEQ ID NO: 399 - DNA, 20 bp, Artificial sequence
  Synthetic oligonucleotide
ctctgcctaaccttctcaaa

SEQ ID NO: 400 - DNA, 20 bp, Artificial sequence
  Synthetic oligonucleotide
tctctgcctaaccttctcaa

SEQ ID NO: 401 - DNA, 20 bp, Artificial sequence
  Synthetic oligonucleotide
ttctctgcctaaccttctca

SEQ ID NO: 402 - DNA, 20 bp, Artificial sequence
  Synthetic oligonucleotide
attctctgcctaaccttctc

SEQ ID NO: 403 - DNA, 20 bp, Artificial sequence
  Synthetic oligonucleotide
tattctctgcctaaccttct

SEQ ID NO: 404 - DNA, 20 bp, Artificial sequence
  Synthetic oligonucleotide
ctattctctgcctaaccttc

SEQ ID NO: 405 - DNA, 20 bp, Artificial sequence
  Synthetic oligonucleotide
tctattctctgcctaacctt

SEQ ID NO: 406 - DNA, 20 bp, Artificial sequence
  Synthetic oligonucleotide
ttctattctctgcctaacct

SEQ ID NO: 407 - DNA, 20 bp, Artificial sequence
  Synthetic oligonucleotide
cttctattctctgcctaacc

SEQ ID NO: 408 - DNA, 20 bp, Artificial sequence
  Synthetic oligonucleotide
gcttctattctctgcctaac

SEQ ID NO: 409 - DNA, 20 bp, Artificial sequence
  Synthetic oligonucleotide
agcttctattctctgcctaa

SEQ ID NO: 410 - DNA, 20 bp, Artificial sequence
  Synthetic oligonucleotide
gagcttctattctctgccta

SEQ ID NO: 411 - DNA, 20 bp, Artificial sequence
  Synthetic oligonucleotide
agagcttctattctctgcct

SEQ ID NO: 412 - DNA, 20 bp, Artificial sequence
  Synthetic oligonucleotide
gagagcttctattctctgcc

SEQ ID NO: 413 - DNA, 20 bp, Artificial sequence
  Synthetic oligonucleotide
agtgagagagcttctattct

SEQ ID NO: 414 - DNA, 20 bp, Artificial sequence
  Synthetic oligonucleotide
gagtgagagagcttctattc

SEQ ID NO: 415 - DNA, 20 bp, Artificial sequence
  Synthetic oligonucleotide
tgagtgagagagcttctatt

SEQ ID NO: 416 - DNA, 20 bp, Artificial sequence
  Synthetic oligonucleotide
atgagtgagagagcttctat

SEQ ID NO: 417 - DNA, 20 bp, Artificial sequence
  Synthetic oligonucleotide
catgagtgagagagcttcta

SEQ ID NO: 418 - DNA, 20 bp, Artificial sequence
  Synthetic oligonucleotide
tgcatgagtgagagagcttc

SEQ ID NO: 419 - DNA, 20 bp, Artificial sequence
  Synthetic oligonucleotide
gtgcatgagtgagagagctt

SEQ ID NO: 420 - DNA, 20 bp, Artificial sequence
  Synthetic oligonucleotide
ggtgcatgagtgagagagct

SEQ ID NO: 421 - DNA, 20 bp, Artificial sequence
  Synthetic oligonucleotide
agggtgcatgagtgagagag

SEQ ID NO: 422 - DNA, 20 bp, Artificial sequence
  Synthetic oligonucleotide
aagggtgcatgagtgagaga

SEQ ID NO: 423 - DNA, 20 bp, Artificial sequence
  Synthetic oligonucleotide
gaagggtgcatgagtgagag

SEQ ID NO: 424 - DNA, 20 bp, Artificial sequence
  Synthetic oligonucleotide
ggaagggtgcatgagtgaga

SEQ ID NO: 425 - DNA, 20 bp, Artificial sequence
  Synthetic oligonucleotide
tggaagggtgcatgagtgag

SEQ ID NO: 426 - DNA, 20 bp, Artificial sequence
  Synthetic oligonucleotide
atggaagggtgcatgagtga

SEQ ID NO: 427 - DNA, 20 bp, Artificial sequence
  Synthetic oligonucleotide
aatggaagggtgcatgagtg

SEQ ID NO: 428 - DNA, 20 bp, Artificial sequence
  Synthetic oligonucleotide
aaatggaagggtgcatgagt

SEQ ID NO: 429 - DNA, 20 bp, Artificial sequence
  Synthetic oligonucleotide
gaaatggaagggtgcatgag

SEQ ID NO: 430 - DNA, 20 bp, Artificial sequence
  Synthetic oligonucleotide
agaaatggaagggtgcatga

SEQ ID NO: 431 - DNA, 20 bp, Artificial sequence
  Synthetic oligonucleotide
aagaaatggaagggtgcatg

SEQ ID NO: 432 - DNA, 20 bp, Artificial sequence
  Synthetic oligonucleotide
aaagaaatggaagggtgcat

SEQ ID NO: 433 - DNA, 20 bp, Artificial sequence
  Synthetic oligonucleotide
gaaagaaatggaagggtgca

SEQ ID NO: 434 - DNA, 20 bp, Artificial sequence
  Synthetic oligonucleotide
agaaagaaatggaagggtgc

SEQ ID NO: 435 - DNA, 20 bp, Artificial sequence
  Synthetic oligonucleotide
gagaaagaaatggaagggtg

SEQ ID NO: 436 - DNA, 20 bp, Artificial sequence
  Synthetic oligonucleotide
agagaaagaaatggaagggt

SEQ ID NO: 437 - DNA, 20 bp, Artificial sequence
  Synthetic oligonucleotide
aagagaaagaaatggaaggg

SEQ ID NO: 438 - DNA, 20 bp, Artificial sequence
  Synthetic oligonucleotide
aaagagaaagaaatggaagg

SEQ ID NO: 439 - DNA, 20 bp, Artificial sequence
  Synthetic oligonucleotide
caaagagaaagaaatggaag

SEQ ID NO: 440 - DNA, 20 bp, Artificial sequence
  Synthetic oligonucleotide
tcaaagagaaagaaatggaa

SEQ ID NO: 441 - DNA, 20 bp, Artificial sequence
  Synthetic oligonucleotide
ctcaaagagaaagaaatgga

SEQ ID NO: 442 - DNA, 20 bp, Artificial sequence
  Synthetic oligonucleotide
tctcaaagagaaagaaatgg

SEQ ID NO: 443 - DNA, 20 bp, Artificial sequence
  Synthetic oligonucleotide
aacatcatttctcaaagaga

SEQ ID NO: 444 - DNA, 20 bp, Artificial sequence
  Synthetic oligonucleotide
aaacatcatttctcaaagag

SEQ ID NO: 445 - DNA, 20 bp, Artificial sequence
  Synthetic oligonucleotide
gaaacatcatttctcaaaga

SEQ ID NO: 446 - DNA, 20 bp, Artificial sequence
  Synthetic oligonucleotide
agaaacatcatttctcaaag

SEQ ID NO: 447 - DNA, 20 bp, Artificial sequence
  Synthetic oligonucleotide
cagaaacatcatttctcaaa

SEQ ID NO: 448 - DNA, 20 bp, Artificial sequence
  Synthetic oligonucleotide
ccagaaacatcatttctcaa

SEQ ID NO: 449 - DNA, 20 bp, Artificial sequence
  Synthetic oligonucleotide
accagaaacatcatttctca

SEQ ID NO: 450 - DNA, 20 bp, Artificial sequence
  Synthetic oligonucleotide
aaccagaaacatcatttctc

SEQ ID NO: 451 - DNA, 20 bp, Artificial sequence
  Synthetic oligonucleotide
ggaaccagaaacatcatttc

SEQ ID NO: 452 - DNA, 20 bp, Artificial sequence
  Synthetic oligonucleotide
tggaaccagaaacatcattt

SEQ ID NO: 453 - DNA, 20 bp, Artificial sequence
  Synthetic oligonucleotide
atggaaccagaaacatcatt

SEQ ID NO: 454 - DNA, 20 bp, Artificial sequence
  Synthetic oligonucleotide
catggaaccagaaacatcat

SEQ ID NO: 455 - DNA, 20 bp, Artificial sequence
  Synthetic oligonucleotide
ccatggaaccagaaacatca

SEQ ID NO: 456 - DNA, 20 bp, Artificial sequence
  Synthetic oligonucleotide
accatggaaccagaaacatc

SEQ ID NO: 457 - DNA, 20 bp, Artificial sequence
  Synthetic oligonucleotide
aaccatggaaccagaaacat

SEQ ID NO: 458 - DNA, 20 bp, Artificial sequence
  Synthetic oligonucleotide
gaaccatggaaccagaaaca

SEQ ID NO: 459 - DNA, 20 bp, Artificial sequence
  Synthetic oligonucleotide
agaaccatggaaccagaaac

SEQ ID NO: 460 - DNA, 20 bp, Artificial sequence
  Synthetic oligonucleotide
aagaaccatggaaccagaaa

SEQ ID NO: 461 - DNA, 20 bp, Artificial sequence
  Synthetic oligonucleotide
gaagaaccatggaaccagaa

SEQ ID NO: 462 - DNA, 20 bp, Artificial sequence
  Synthetic oligonucleotide
tgaagaaccatggaaccaga

SEQ ID NO: 463 - DNA, 20 bp, Artificial sequence
  Synthetic oligonucleotide
ctgaagaaccatggaaccag

SEQ ID NO: 464 - DNA, 20 bp, Artificial sequence
  Synthetic oligonucleotide
gctgaagaaccatggaacca

SEQ ID NO: 465 - DNA, 20 bp, Artificial sequence
  Synthetic oligonucleotide
agctgaagaaccatggaacc

SEQ ID NO: 466 - DNA, 20 bp, Artificial sequence
  Synthetic oligonucleotide
gagctgaagaaccatggaac

SEQ ID NO: 467 - DNA, 20 bp, Artificial sequence
  Synthetic oligonucleotide
ggagctgaagaaccatggaa

SEQ ID NO: 468 - DNA, 20 bp, Artificial sequence
  Synthetic oligonucleotide
gggagctgaagaaccatgga

SEQ ID NO: 469 - DNA, 20 bp, Artificial sequence
  Synthetic oligonucleotide
agggagctgaagaaccatgg

SEQ ID NO: 470 - DNA, 20 bp, Artificial sequence
  Synthetic oligonucleotide
tagggagctgaagaaccatg

SEQ ID NO: 471 - DNA, 20 bp, Artificial sequence
  Synthetic oligonucleotide
ttagggagctgaagaaccat

SEQ ID NO: 472 - DNA, 20 bp, Artificial sequence
  Synthetic oligonucleotide
tttagggagctgaagaacca

SEQ ID NO: 473 - DNA, 20 bp, Artificial sequence
  Synthetic oligonucleotide
ttttagggagctgaagaacc

SEQ ID NO: 474 - DNA, 20 bp, Artificial sequence
  Synthetic oligonucleotide
gttttagggagctgaagaac

SEQ ID NO: 475 - DNA, 20 bp, Artificial sequence
  Synthetic oligonucleotide
ggttttagggagctgaagaa

SEQ ID NO: 476 - DNA, 20 bp, Artificial sequence
  Synthetic oligonucleotide
tggttttagggagctgaaga

SEQ ID NO: 477 - DNA, 20 bp, Artificial sequence
  Synthetic oligonucleotide
ttggttttagggagctgaag

SEQ ID NO: 478 - DNA, 20 bp, Artificial sequence
  Synthetic oligonucleotide
tttggttttagggagctgaa

SEQ ID NO: 479 - DNA, 20 bp, Artificial sequence
  Synthetic oligonucleotide
ctttggttttagggagctga

SEQ ID NO: 480 - DNA, 20 bp, Artificial sequence
  Synthetic oligonucleotide
tctttggttttagggagctg

SEQ ID NO: 481 - DNA, 20 bp, Artificial sequence
  Synthetic oligonucleotide
gtctttggttttagggagct

SEQ ID NO: 482 - DNA, 20 bp, Artificial sequence
  Synthetic oligonucleotide
cgtctttggttttagggagc

SEQ ID NO: 483 - DNA, 20 bp, Artificial sequence
  Synthetic oligonucleotide
acgtctttggttttagggag

SEQ ID NO: 484 - DNA, 20 bp, Artificial sequence
  Synthetic oligonucleotide
tacgtctttggttttaggga

SEQ ID NO: 485 - DNA, 20 bp, Artificial sequence
  Synthetic oligonucleotide
atacgtctttggttttaggg

SEQ ID NO: 486 - DNA, 20 bp, Artificial sequence
  Synthetic oligonucleotide
catacgtctttggttttagg

SEQ ID NO: 487 - DNA, 20 bp, Artificial sequence
  Synthetic oligonucleotide
acatacgtctttggttttag

SEQ ID NO: 488 - DNA, 20 bp, Artificial sequence
  Synthetic oligonucleotide
aacatacgtctttggtttta

SEQ ID NO: 489 - DNA, 20 bp, Artificial sequence
  Synthetic oligonucleotide
gaacatacgtctttggtttt

SEQ ID NO: 490 - DNA, 20 bp, Artificial sequence
  Synthetic oligonucleotide
ggaacatacgtctttggttt

SEQ ID NO: 491 - DNA, 20 bp, Artificial sequence
  Synthetic oligonucleotide
gggaacatacgtctttggtt

SEQ ID NO: 492 - DNA, 20 bp, Artificial sequence
  Synthetic oligonucleotide
cgggaacatacgtctttggt

SEQ ID NO: 493 - DNA, 20 bp, Artificial sequence
  Synthetic oligonucleotide
tcgggaacatacgtctttgg

SEQ ID NO: 494 - DNA, 20 bp, Artificial sequence
  Synthetic oligonucleotide
atcgggaacatacgtctttg

SEQ ID NO: 495 - DNA, 20 bp, Artificial sequence
  Synthetic oligonucleotide
aatcgggaacatacgtcttt

SEQ ID NO: 496 - DNA, 20 bp, Artificial sequence
  Synthetic oligonucleotide
aaatcgggaacatacgtctt

SEQ ID NO: 497 - DNA, 20 bp, Artificial sequence
  Synthetic oligonucleotide
aaaatcgggaacatacgtct

SEQ ID NO: 498 - DNA, 20 bp, Artificial sequence
  Synthetic oligonucleotide
caaaatcgggaacatacgtc

SEQ ID NO: 499 - DNA, 20 bp, Artificial sequence
  Synthetic oligonucleotide
acaaaatcgggaacatacgt

SEQ ID NO: 500 - DNA, 20 bp, Artificial sequence
  Synthetic oligonucleotide
gacaaaatcgggaacatacg

SEQ ID NO: 501 - DNA, 20 bp, Artificial sequence
  Synthetic oligonucleotide
tgacaaaatcgggaacatac

SEQ ID NO: 502 - DNA, 20 bp, Artificial sequence
  Synthetic oligonucleotide
ttgacaaaatcgggaacata

SEQ ID NO: 503 - DNA, 20 bp, Artificial sequence
  Synthetic oligonucleotide
tttgacaaaatcgggaacat

SEQ ID NO: 504 - DNA, 20 bp, Artificial sequence
  Synthetic oligonucleotide
atttgacaaaatcgggaaca

SEQ ID NO: 505 - DNA, 20 bp, Artificial sequence
  Synthetic oligonucleotide
aatttgacaaaatcgggaac

SEQ ID NO: 506 - DNA, 20 bp, Artificial sequence
  Synthetic oligonucleotide
aaatttgacaaaatcgggaa

SEQ ID NO: 507 - DNA, 20 bp, Artificial sequence
  Synthetic oligonucleotide
taaatttgacaaaatcggga

SEQ ID NO: 508 - DNA, 20 bp, Artificial sequence
  Synthetic oligonucleotide
ataaatttgacaaaatcggg

SEQ ID NO: 509 - DNA, 20 bp, Artificial sequence
  Synthetic oligonucleotide
cataaatttgacaaaatcgg

SEQ ID NO: 510 - DNA, 20 bp, Artificial sequence
  Synthetic oligonucleotide
ccataaatttgacaaaatcg

SEQ ID NO: 511 - DNA, 20 bp, Artificial sequence
  Synthetic oligonucleotide
tccataaatttgacaaaatc

SEQ ID NO: 512 - DNA, 20 bp, Artificial sequence
  Synthetic oligonucleotide
caatccataaatttgacaaa

SEQ ID NO: 513 - DNA, 20 bp, Artificial sequence
  Synthetic oligonucleotide
ccaatccataaatttgacaa

SEQ ID NO: 514 - DNA, 20 bp, Artificial sequence
  Synthetic oligonucleotide
cccaatccataaatttgaca

SEQ ID NO: 515 - DNA, 20 bp, Artificial sequence
  Synthetic oligonucleotide
tcccaatccataaatttgac

SEQ ID NO: 516 - DNA, 20 bp, Artificial sequence
  Synthetic oligonucleotide
ttcccaatccataaatttga

SEQ ID NO: 517 - DNA, 20 bp, Artificial sequence
  Synthetic oligonucleotide
tttcccaatccataaatttg

SEQ ID NO: 518 - DNA, 20 bp, Artificial sequence
  Synthetic oligonucleotide
ctttcccaatccataaattt

SEQ ID NO: 519 - DNA, 20 bp, Artificial sequence
  Synthetic oligonucleotide
actttcccaatccataaatt

SEQ ID NO: 520 - DNA, 20 bp, Artificial sequence
  Synthetic oligonucleotide
gactttcccaatccataaat

SEQ ID NO: 521 - DNA, 20 bp, Artificial sequence
  Synthetic oligonucleotide
ggactttcccaatccataaa

SEQ ID NO: 522 - DNA, 20 bp, Artificial sequence
  Synthetic oligonucleotide
cttagcttttgggactttcc

SEQ ID NO: 523 - DNA, 20 bp, Artificial sequence
  Synthetic oligonucleotide
tcttagcttttgggactttc

SEQ ID NO: 524 - DNA, 20 bp, Artificial sequence
  Synthetic oligonucleotide
ctcttagcttttgggacttt

SEQ ID NO: 525 - DNA, 20 bp, Artificial sequence
  Synthetic oligonucleotide
tctcttagcttttgggactt

SEQ ID NO: 526 - DNA, 20 bp, Artificial sequence
  Synthetic oligonucleotide
ttctcttagcttttgggact

SEQ ID NO: 527 - DNA, 20 bp, Artificial sequence
  Synthetic oligonucleotide
tttctcttagcttttgggac

SEQ ID NO: 528 - DNA, 20 bp, Artificial sequence
  Synthetic oligonucleotide
atttctcttagcttttggga

SEQ ID NO: 529 - DNA, 20 bp, Artificial sequence
  Synthetic oligonucleotide
tatttctcttagcttttggg

SEQ ID NO: 530 - DNA, 20 bp, Artificial sequence
  Synthetic oligonucleotide
ttatttctcttagcttttgg

SEQ ID NO: 531 - DNA, 20 bp, Artificial sequence
  Synthetic oligonucleotide
cttatttctcttagcttttg

SEQ ID NO: 532 - DNA, 20 bp, Artificial sequence
  Synthetic oligonucleotide
acttatttctcttagctttt

SEQ ID NO: 533 - DNA, 20 bp, Artificial sequence
  Synthetic oligonucleotide
aacttatttctcttagcttt

SEQ ID NO: 534 - DNA, 20 bp, Artificial sequence
  Synthetic oligonucleotide
aaacttatttctcttagctt

SEQ ID NO: 535 - DNA, 20 bp, Artificial sequence
  Synthetic oligonucleotide
aaaacttatttctcttagct

SEQ ID NO: 536 - DNA, 20 bp, Artificial sequence
  Synthetic oligonucleotide
taaaacttatttctcttagc

SEQ ID NO: 537 - DNA, 20 bp, Artificial sequence
  Synthetic oligonucleotide
gctcaaactctttatattta

SEQ ID NO: 538 - DNA, 20 bp, Artificial sequence
  Synthetic oligonucleotide
agctcaaactctttatattt

SEQ ID NO: 539 - DNA, 20 bp, Artificial sequence
  Synthetic oligonucleotide
aagctcaaactctttatatt

SEQ ID NO: 540 - DNA, 20 bp, Artificial sequence
  Synthetic oligonucleotide
taagctcaaactctttatat

SEQ ID NO: 541 - DNA, 20 bp, Artificial sequence
  Synthetic oligonucleotide
ctaagctcaaactctttata

SEQ ID NO: 542 - DNA, 20 bp, Artificial sequence
  Synthetic oligonucleotide
actaagctcaaactctttat

SEQ ID NO: 543 - DNA, 20 bp, Artificial sequence
  Synthetic oligonucleotide
cactaagctcaaactcttta

SEQ ID NO: 544 - DNA, 20 bp, Artificial sequence
  Synthetic oligonucleotide
ccactaagctcaaactcttt

SEQ ID NO: 545 - DNA, 20 bp, Artificial sequence
  Synthetic oligonucleotide
gccactaagctcaaactctt

SEQ ID NO: 546 - DNA, 20 bp, Artificial sequence
  Synthetic oligonucleotide
agccactaagctcaaactct

SEQ ID NO: 547 - DNA, 20 bp, Artificial sequence
  Synthetic oligonucleotide
tgttgtaatgtgcttcagag

SEQ ID NO: 548 - DNA, 20 bp, Artificial sequence
  Synthetic oligonucleotide
ttgttgtaatgtgcttcaga

SEQ ID NO: 549 - DNA, 20 bp, Artificial sequence
  Synthetic oligonucleotide
cttgttgtaatgtgcttcag

SEQ ID NO: 550 - DNA, 20 bp, Artificial sequence
  Synthetic oligonucleotide
tcttgttgtaatgtgcttca

SEQ ID NO: 551 - DNA, 20 bp, Artificial sequence
  Synthetic oligonucleotide
ttcttgttgtaatgtgcttc

SEQ ID NO: 552 - DNA, 20 bp, Artificial sequence
  Synthetic oligonucleotide
attcttgttgtaatgtgctt

SEQ ID NO: 553 - DNA, 20 bp, Artificial sequence
  Synthetic oligonucleotide
tattcttgttgtaatgtgct

SEQ ID NO: 554 - DNA, 20 bp, Artificial sequence
  Synthetic oligonucleotide
atattcttgttgtaatgtgc

SEQ ID NO: 555 - DNA, 20 bp, Artificial sequence
  Synthetic oligonucleotide
catattcttgttgtaatgtg

SEQ ID NO: 556 - DNA, 20 bp, Artificial sequence
  Synthetic oligonucleotide
gcatattcttgttgtaatgt

SEQ ID NO: 557 - DNA, 20 bp, Artificial sequence
  Synthetic oligonucleotide
tgcatattcttgttgtaatg

SEQ ID NO: 558 - DNA, 20 bp, Artificial sequence
  Synthetic oligonucleotide
ctgcatattcttgttgtaat

SEQ ID NO: 559 - DNA, 20 bp, Artificial sequence
  Synthetic oligonucleotide
actgcatattcttgttgtaa

SEQ ID NO: 560 - DNA, 20 bp, Artificial sequence
  Synthetic oligonucleotide
aactgcatattcttgttgta

SEQ ID NO: 561 - DNA, 20 bp, Artificial sequence
  Synthetic oligonucleotide
aaactgcatattcttgttgt

SEQ ID NO: 562 - DNA, 20 bp, Artificial sequence
  Synthetic oligonucleotide
aaaactgcatattcttgttg

SEQ ID NO: 563 - DNA, 20 bp, Artificial sequence
  Synthetic oligonucleotide
aaaaactgcatattcttgtt

SEQ ID NO: 564 - DNA, 20 bp, Artificial sequence
  Synthetic oligonucleotide
caaaaactgcatattcttgt

SEQ ID NO: 565 - DNA, 20 bp, Artificial sequence
  Synthetic oligonucleotide
acaaaaactgcatattcttg

SEQ ID NO: 566 - DNA, 20 bp, Artificial sequence
  Synthetic oligonucleotide
aacaaaaactgcatattctt

SEQ ID NO: 567 - DNA, 20 bp, Artificial sequence
  Synthetic oligonucleotide
aaacaaaaactgcatattct

SEQ ID NO: 568 - DNA, 20 bp, Artificial sequence
  Synthetic oligonucleotide
caaacaaaaactgcatattc

SEQ ID NO: 569 - DNA, 20 bp, Artificial sequence
  Synthetic oligonucleotide
acaaacaaaaactgcatatt

SEQ ID NO: 570 - DNA, 20 bp, Artificial sequence
  Synthetic oligonucleotide
cacaaacaaaaactgcatat

SEQ ID NO: 571 - DNA, 20 bp, Artificial sequence
  Synthetic oligonucleotide
tcacaaacaaaaactgcata

SEQ ID NO: 572 - DNA, 20 bp, Artificial sequence
  Synthetic oligonucleotide
ttcacaaacaaaaactgcat

SEQ ID NO: 573 - DNA, 20 bp, Artificial sequence
  Synthetic oligonucleotide
gttcacaaacaaaaactgca

SEQ ID NO: 574 - DNA, 20 bp, Artificial sequence
  Synthetic oligonucleotide
aactagtcttttgttcacaa

SEQ ID NO: 575 - DNA, 20 bp, Artificial sequence
  Synthetic oligonucleotide
aaactagtcttttgttcaca

SEQ ID NO: 576 - DNA, 20 bp, Artificial sequence
  Synthetic oligonucleotide
aaaactagtcttttgttcac

SEQ ID NO: 577 - DNA, 20 bp, Artificial sequence
  Synthetic oligonucleotide
taaaactagtcttttgttca

SEQ ID NO: 578 - DNA, 20 bp, Artificial sequence
  Synthetic oligonucleotide
ttaaaactagtcttttgttc

SEQ ID NO: 579 - DNA, 20 bp, Artificial sequence
  Synthetic oligonucleotide
cttaaaactagtcttttgtt

SEQ ID NO: 580 - DNA, 20 bp, Artificial sequence
  Synthetic oligonucleotide
ccttaaaactagtcttttgt

SEQ ID NO: 581 - DNA, 20 bp, Artificial sequence
  Synthetic oligonucleotide
tccttaaaactagtcttttg

SEQ ID NO: 582 - DNA, 20 bp, Artificial sequence
  Synthetic oligonucleotide
gtccttaaaactagtctttt

SEQ ID NO: 583 - DNA, 20 bp, Artificial sequence
  Synthetic oligonucleotide
tgtccttaaaactagtcttt

SEQ ID NO: 584 - DNA, 20 bp, Artificial sequence
  Synthetic oligonucleotide
ttgtccttaaaactagtctt

SEQ ID NO: 585 - DNA, 20 bp, Artificial sequence
  Synthetic oligonucleotide
tttgtccttaaaactagtct

SEQ ID NO: 586 - DNA, 20 bp, Artificial sequence
  Synthetic oligonucleotide
ctttgtccttaaaactagtc

SEQ ID NO: 587 - DNA, 20 bp, Artificial sequence
  Synthetic oligonucleotide
gctttgtccttaaaactagt

SEQ ID NO: 588 - DNA, 20 bp, Artificial sequence
  Synthetic oligonucleotide
agctttgtccttaaaactag

SEQ ID NO: 589 - DNA, 20 bp, Artificial sequence
  Synthetic oligonucleotide
tagctttgtccttaaaacta

SEQ ID NO: 590 - DNA, 20 bp, Artificial sequence
  Synthetic oligonucleotide
gtagctttgtccttaaaact

SEQ ID NO: 591 - DNA, 20 bp, Artificial sequence
  Synthetic oligonucleotide
tgtagctttgtccttaaaac

SEQ ID NO: 592 - DNA, 20 bp, Artificial sequence
  Synthetic oligonucleotide
atgtagctttgtccttaaaa

SEQ ID NO: 593 - DNA, 20 bp, Artificial sequence
  Synthetic oligonucleotide
tatgtagctttgtccttaaa

SEQ ID NO: 594 - DNA, 20 bp, Artificial sequence
  Synthetic oligonucleotide
ttatgtagctttgtccttaa

SEQ ID NO: 595 - DNA, 20 bp, Artificial sequence
  Synthetic oligonucleotide
tttatgtagctttgtcctta

SEQ ID NO: 596 - DNA, 20 bp, Artificial sequence
  Synthetic oligonucleotide
gtttatgtagctttgtcctt

SEQ ID NO: 597 - DNA, 20 bp, Artificial sequence
  Synthetic oligonucleotide
agtttatgtagctttgtcct

SEQ ID NO: 598 - DNA, 20 bp, Artificial sequence
  Synthetic oligonucleotide
gagtttatgtagctttgtcc

SEQ ID NO: 599 - DNA, 20 bp, Artificial sequence
  Synthetic oligonucleotide
tgagtttatgtagctttgtc

SEQ ID NO: 600 - DNA, 20 bp, Artificial sequence
  Synthetic oligonucleotide
atgagtttatgtagctttgt

SEQ ID NO: 601 - DNA, 20 bp, Artificial sequence
  Synthetic oligonucleotide
aatgagtttatgtagctttg

SEQ ID NO: 602 - DNA, 20 bp, Artificial sequence
  Synthetic oligonucleotide
caatgagtttatgtagcttt

SEQ ID NO: 603 - DNA, 20 bp, Artificial sequence
  Synthetic oligonucleotide
tcaatgagtttatgtagctt

SEQ ID NO: 604 - DNA, 20 bp, Artificial sequence
  Synthetic oligonucleotide
gtcaatgagtttatgtagct

SEQ ID NO: 605 - DNA, 20 bp, Artificial sequence
  Synthetic oligonucleotide
agtcaatgagtttatgtagc

SEQ ID NO: 606 - DNA, 20 bp, Artificial sequence
  Synthetic oligonucleotide
aagtcaatgagtttatgtag

SEQ ID NO: 607 - DNA, 20 bp, Artificial sequence
  Synthetic oligonucleotide
aaagtcaatgagtttatgta

SEQ ID NO: 608 - DNA, 20 bp, Artificial sequence
  Synthetic oligonucleotide
aaaagtcaatgagtttatgt

SEQ ID NO: 609 - DNA, 20 bp, Artificial sequence
  Synthetic oligonucleotide
aaaaagtcaatgagtttatg

SEQ ID NO: 610 - DNA, 20 bp, Artificial sequence
  Synthetic oligonucleotide
cttaataaaaagtcaatgag

SEQ ID NO: 611 - DNA, 20 bp, Artificial sequence
  Synthetic oligonucleotide
ccttaataaaaagtcaatga

SEQ ID NO: 612 - DNA, 20 bp, Artificial sequence
  Synthetic oligonucleotide
tccttaataaaaagtcaatg

SEQ ID NO: 613 - DNA, 20 bp, Artificial sequence
  Synthetic oligonucleotide
ctttccttaataaaaagtca

SEQ ID NO: 614 - DNA, 20 bp, Artificial sequence
  Synthetic oligonucleotide
tctttccttaataaaaagtc

SEQ ID NO: 615 - DNA, 20 bp, Artificial sequence
  Synthetic oligonucleotide
catataatactttctttcct

SEQ ID NO: 616 - DNA, 20 bp, Artificial sequence
  Synthetic oligonucleotide
gcatataatactttctttcc

SEQ ID NO: 617 - DNA, 20 bp, Artificial sequence
  Synthetic oligonucleotide
tgcatataatactttctttc

SEQ ID NO: 618 - DNA, 20 bp, Artificial sequence
  Synthetic oligonucleotide
cttgcatataatactttctt

SEQ ID NO: 619 - DNA, 20 bp, Artificial sequence
  Synthetic oligonucleotide
gcttgcatataatactttct

SEQ ID NO: 620 - DNA, 20 bp, Artificial sequence
  Synthetic oligonucleotide
ggcttgcatataatactttc

SEQ ID NO: 621 - DNA, 20 bp, Artificial sequence
  Synthetic oligonucleotide
tggcttgcatataatacttt

SEQ ID NO: 622 - DNA, 20 bp, Artificial sequence
  Synthetic oligonucleotide
ttggcttgcatataatactt

SEQ ID NO: 623 - DNA, 20 bp, Artificial sequence
  Synthetic oligonucleotide
tttggcttgcatataatact

SEQ ID NO: 624 - DNA, 20 bp, Artificial sequence
  Synthetic oligonucleotide
ctttggcttgcatataatac

SEQ ID NO: 625 - DNA, 20 bp, Artificial sequence
  Synthetic oligonucleotide
tctttggcttgcatataata

SEQ ID NO: 626 - DNA, 20 bp, Artificial sequence
  Synthetic oligonucleotide
ttctttggcttgcatataat

SEQ ID NO: 627 - DNA, 20 bp, Artificial sequence
  Synthetic oligonucleotide
attctttggcttgcatataa

SEQ ID NO: 628 - DNA, 20 bp, Artificial sequence
  Synthetic oligonucleotide
cattctttggcttgcatata

SEQ ID NO: 629 - DNA, 20 bp, Artificial sequence
  Synthetic oligonucleotide
ccattctttggcttgcatat

SEQ ID NO: 630 - DNA, 20 bp, Artificial sequence
  Synthetic oligonucleotide
catttgcctactggtgggac

SEQ ID NO: 631 - DNA, 20 bp, Artificial sequence
  Synthetic oligonucleotide
tcatttgcctactggtggga

SEQ ID NO: 632 - DNA, 20 bp, Artificial sequence
  Synthetic oligonucleotide
ttcatttgcctactggtggg

SEQ ID NO: 633 - DNA, 20 bp, Artificial sequence
  Synthetic oligonucleotide
attcatttgcctactggtgg

SEQ ID NO: 634 - DNA, 20 bp, Artificial sequence
  Synthetic oligonucleotide
aattcatttgcctactggtg

SEQ ID NO: 635 - DNA, 20 bp, Artificial sequence
  Synthetic oligonucleotide
gaattcatttgcctactggt

SEQ ID NO: 636 - DNA, 20 bp, Artificial sequence
  Synthetic oligonucleotide
tgaattcatttgcctactgg

SEQ ID NO: 637 - DNA, 20 bp, Artificial sequence
  Synthetic oligonucleotide
ttgaattcatttgcctactg

SEQ ID NO: 638 - DNA, 20 bp, Artificial sequence
  Synthetic oligonucleotide
cttgaattcatttgcctact

SEQ ID NO: 639 - DNA, 20 bp, Artificial sequence
  Synthetic oligonucleotide
acttgaattcatttgcctac

SEQ ID NO: 640 - DNA, 20 bp, Artificial sequence
  Synthetic oligonucleotide
gacttgaattcatttgccta

SEQ ID NO: 641 - DNA, 20 bp, Artificial sequence
  Synthetic oligonucleotide
agacttgaattcatttgcct

SEQ ID NO: 642 - DNA, 20 bp, Artificial sequence
  Synthetic oligonucleotide
aagacttgaattcatttgcc

SEQ ID NO: 643 - DNA, 20 bp, Artificial sequence
  Synthetic oligonucleotide
gaagacttgaattcatttgc

SEQ ID NO: 644 - DNA, 20 bp, Artificial sequence
  Synthetic oligonucleotide
cgaagacttgaattcatttg

SEQ ID NO: 645 - DNA, 20 bp, Artificial sequence
  Synthetic oligonucleotide
ccgaagacttgaattcattt

SEQ ID NO: 646 - DNA, 20 bp, Artificial sequence
  Synthetic oligonucleotide
gccgaagacttgaattcatt

SEQ ID NO: 647 - DNA, 20 bp, Artificial sequence
  Synthetic oligonucleotide
tgccgaagacttgaattcat

SEQ ID NO: 648 - DNA, 20 bp, Artificial sequence
  Synthetic oligonucleotide
gtgccgaagacttgaattca

SEQ ID NO: 649 - DNA, 20 bp, Artificial sequence
  Synthetic oligonucleotide
ggtgccgaagacttgaattc

SEQ ID NO: 650 - DNA, 20 bp, Artificial sequence
  Synthetic oligonucleotide
atatgccatagagttctggg

SEQ ID NO: 651 - DNA, 20 bp, Artificial sequence
  Synthetic oligonucleotide
tatatgccatagagttctgg

SEQ ID NO: 652 - DNA, 20 bp, Artificial sequence
  Synthetic oligonucleotide
atatatgccatagagttctg

SEQ ID NO: 653 - DNA, 20 bp, Artificial sequence
  Synthetic oligonucleotide
catatatgccatagagttct

SEQ ID NO: 654 - DNA, 20 bp, Artificial sequence
  Synthetic oligonucleotide
acatatatgccatagagttc

SEQ ID NO: 655 - DNA, 20 bp, Artificial sequence
  Synthetic oligonucleotide
tacatatatgccatagagtt

SEQ ID NO: 656 - DNA, 20 bp, Artificial sequence
  Synthetic oligonucleotide
ttacatatatgccatagagt

SEQ ID NO: 657 - DNA, 20 bp, Artificial sequence
  Synthetic oligonucleotide
attacatatatgccatagag

SEQ ID NO: 658 - DNA, 20 bp, Artificial sequence
  Synthetic oligonucleotide
aattacatatatgccataga

SEQ ID NO: 659 - DNA, 20 bp, Artificial sequence
  Synthetic oligonucleotide
taattacatatatgccatag

SEQ ID NO: 660 - DNA, 20 bp, Artificial sequence
  Synthetic oligonucleotide
cattaattacatatatgcca

SEQ ID NO: 661 - DNA, 20 bp, Artificial sequence
  Synthetic oligonucleotide
acattaattacatatatgcc

SEQ ID NO: 662 - DNA, 20 bp, Artificial sequence
  Synthetic oligonucleotide
cacattaattacatatatgc

SEQ ID NO: 663 - DNA, 20 bp, Artificial sequence
  Synthetic oligonucleotide
gcacattaattacatatatg

SEQ ID NO: 664 - DNA, 20 bp, Artificial sequence
  Synthetic oligonucleotide
ctgcacattaattacatata

SEQ ID NO: 665 - DNA, 20 bp, Artificial sequence
  Synthetic oligonucleotide
actgcacattaattacatat

SEQ ID NO: 666 - DNA, 20 bp, Artificial sequence
  Synthetic oligonucleotide
cactgcacattaattacata

SEQ ID NO: 667 - DNA, 20 bp, Artificial sequence
  Synthetic oligonucleotide
gcactgcacattaattacat

SEQ ID NO: 668 - DNA, 20 bp, Artificial sequence
  Synthetic oligonucleotide
ggcactgcacattaattaca

SEQ ID NO: 669 - DNA, 20 bp, Artificial sequence
  Synthetic oligonucleotide
tggcactgcacattaattac

SEQ ID NO: 670 - DNA, 20 bp, Artificial sequence
  Synthetic oligonucleotide
ttggcactgcacattaatta

SEQ ID NO: 671 - DNA, 20 bp, Artificial sequence
  Synthetic oligonucleotide
attggcactgcacattaatt

SEQ ID NO: 672 - DNA, 20 bp, Artificial sequence
  Synthetic oligonucleotide
aattggcactgcacattaat

SEQ ID NO: 673 - DNA, 20 bp, Artificial sequence
  Synthetic oligonucleotide
gaattggcactgcacattaa

SEQ ID NO: 674 - DNA, 20 bp, Artificial sequence
  Synthetic oligonucleotide
agaattggcactgcacatta

SEQ ID NO: 675 - DNA, 20 bp, Artificial sequence
  Synthetic oligonucleotide
cagaattggcactgcacatt

SEQ ID NO: 676 - DNA, 20 bp, Artificial sequence
  Synthetic oligonucleotide
acagaattggcactgcacat

SEQ ID NO: 677 - DNA, 20 bp, Artificial sequence
  Synthetic oligonucleotide
cacagaattggcactgcaca

SEQ ID NO: 678 - DNA, 20 bp, Artificial sequence
  Synthetic oligonucleotide
tcacagaattggcactgcac

SEQ ID NO: 679 - DNA, 20 bp, Artificial sequence
  Synthetic oligonucleotide
ctcacagaattggcactgca

SEQ ID NO: 680 - DNA, 20 bp, Artificial sequence
  Synthetic oligonucleotide
actcacagaattggcactgc

SEQ ID NO: 681 - DNA, 20 bp, Artificial sequence
  Synthetic oligonucleotide
atactcacagaattggcact

SEQ ID NO: 682 - DNA, 20 bp, Artificial sequence
  Synthetic oligonucleotide
catactcacagaattggcac

SEQ ID NO: 683 - DNA, 20 bp, Artificial sequence
  Synthetic oligonucleotide
tcatactcacagaattggca

SEQ ID NO: 684 - DNA, 20 bp, Artificial sequence
  Synthetic oligonucleotide
atcatactcacagaattggc

SEQ ID NO: 685 - DNA, 20 bp, Artificial sequence
  Synthetic oligonucleotide
catcatactcacagaattgg

SEQ ID NO: 686 - DNA, 20 bp, Artificial sequence
  Synthetic oligonucleotide
acatcatactcacagaattg

SEQ ID NO: 687 - DNA, 20 bp, Artificial sequence
  Synthetic oligonucleotide
cacatcatactcacagaatt

SEQ ID NO: 688 - DNA, 20 bp, Artificial sequence
  Synthetic oligonucleotide
acacatcatactcacagaat

SEQ ID NO: 689 - DNA, 20 bp, Artificial sequence
  Synthetic oligonucleotide
cacacatcatactcacagaa

SEQ ID NO: 690 - DNA, 20 bp, Artificial sequence
  Synthetic oligonucleotide
gcacacatcatactcacaga

SEQ ID NO: 691 - DNA, 20 bp, Artificial sequence
  Synthetic oligonucleotide
tgcacacatcatactcacag

SEQ ID NO: 692 - DNA, 20 bp, Artificial sequence
  Synthetic oligonucleotide
atgcacacatcatactcaca

SEQ ID NO: 693 - DNA, 20 bp, Artificial sequence
  Synthetic oligonucleotide
catgcacacatcatactcac

SEQ ID NO: 694 - DNA, 20 bp, Artificial sequence
  Synthetic oligonucleotide
ccatgcacacatcatactca

SEQ ID NO: 695 - DNA, 20 bp, Artificial sequence
  Synthetic oligonucleotide
tccatgcacacatcatactc

SEQ ID NO: 696 - DNA, 20 bp, Artificial sequence
  Synthetic oligonucleotide
ctccatgcacacatcatact

SEQ ID NO: 697 - DNA, 20 bp, Artificial sequence
  Synthetic oligonucleotide
gagttttggctggctccatg

SEQ ID NO: 698 - DNA, 20 bp, Artificial sequence
  Synthetic oligonucleotide
agagttttggctggctccat

SEQ ID NO: 699 - DNA, 20 bp, Artificial sequence
  Synthetic oligonucleotide
cagagttttggctggctcca

SEQ ID NO: 700 - DNA, 20 bp, Artificial sequence
  Synthetic oligonucleotide
tcagagttttggctggctcc

SEQ ID NO: 701 - DNA, 20 bp, Artificial sequence
  Synthetic oligonucleotide
atcagagttttggctggctc

SEQ ID NO: 702 - DNA, 20 bp, Artificial sequence
  Synthetic oligonucleotide
aatcagagttttggctggct

SEQ ID NO: 703 - DNA, 20 bp, Artificial sequence
  Synthetic oligonucleotide
caatcagagttttggctggc

SEQ ID NO: 704 - DNA, 20 bp, Artificial sequence
  Synthetic oligonucleotide
tcaatcagagttttggctgg

SEQ ID NO: 705 - DNA, 20 bp, Artificial sequence
  Synthetic oligonucleotide
ttcaatcagagttttggctg

SEQ ID NO: 706 - DNA, 20 bp, Artificial sequence
  Synthetic oligonucleotide
attcaatcagagttttggct

SEQ ID NO: 707 - DNA, 20 bp, Artificial sequence
  Synthetic oligonucleotide
aattcaatcagagttttggc

SEQ ID NO: 708 - DNA, 20 bp, Artificial sequence
  Synthetic oligonucleotide
aaattcaatcagagttttgg

SEQ ID NO: 709 - DNA, 20 bp, Artificial sequence
  Synthetic oligonucleotide
gaaattcaatcagagttttg

SEQ ID NO: 710 - DNA, 20 bp, Artificial sequence
  Synthetic oligonucleotide
tgaaattcaatcagagtttt

SEQ ID NO: 711 - DNA, 20 bp, Artificial sequence
  Synthetic oligonucleotide
ccagttctgaaattcaatca

SEQ ID NO: 712 - DNA, 20 bp, Artificial sequence
  Synthetic oligonucleotide
cccagttctgaaattcaatc

SEQ ID NO: 713 - DNA, 20 bp, Artificial sequence
  Synthetic oligonucleotide
tcccagttctgaaattcaat

SEQ ID NO: 714 - DNA, 20 bp, Artificial sequence
  Synthetic oligonucleotide
gtcccagttctgaaattcaa

SEQ ID NO: 715 - DNA, 20 bp, Artificial sequence
  Synthetic oligonucleotide
tgtcccagttctgaaattca

SEQ ID NO: 716 - DNA, 20 bp, Artificial sequence
  Synthetic oligonucleotide
gtgtcccagttctgaaattc

SEQ ID NO: 717 - DNA, 20 bp, Artificial sequence
  Synthetic oligonucleotide
agtgtcccagttctgaaatt

SEQ ID NO: 718 - DNA, 20 bp, Artificial sequence
  Synthetic oligonucleotide
gagtgtcccagttctgaaat

SEQ ID NO: 719 - DNA, 20 bp, Artificial sequence
  Synthetic oligonucleotide
agagtgtcccagttctgaaa

SEQ ID NO: 720 - DNA, 20 bp, Artificial sequence
  Synthetic oligonucleotide
gagagtgtcccagttctgaa

SEQ ID NO: 721 - DNA, 20 bp, Artificial sequence
  Synthetic oligonucleotide
agagagtgtcccagttctga

SEQ ID NO: 722 - DNA, 20 bp, Artificial sequence
  Synthetic oligonucleotide
aagagagtgtcccagttctg

SEQ ID NO: 723 - DNA, 20 bp, Artificial sequence
  Synthetic oligonucleotide
caagagagtgtcccagttct

SEQ ID NO: 724 - DNA, 20 bp, Artificial sequence
  Synthetic oligonucleotide
acaagagagtgtcccagttc

SEQ ID NO: 725 - DNA, 20 bp, Artificial sequence
  Synthetic oligonucleotide
aacaagagagtgtcccagtt

SEQ ID NO: 726 - DNA, 20 bp, Artificial sequence
  Synthetic oligonucleotide
aaacaagagagtgtcccagt

SEQ ID NO: 727 - DNA, 20 bp, Artificial sequence
  Synthetic oligonucleotide
aaaacaagagagtgtcccag

SEQ ID NO: 728 - DNA, 20 bp, Artificial sequence
  Synthetic oligonucleotide
caaaacaagagagtgtccca

SEQ ID NO: 729 - DNA, 20 bp, Artificial sequence
  Synthetic oligonucleotide
gcaaaacaagagagtgtccc

SEQ ID NO: 730 - DNA, 20 bp, Artificial sequence
  Synthetic oligonucleotide
tgcaaaacaagagagtgtcc

SEQ ID NO: 731 - DNA, 20 bp, Artificial sequence
  Synthetic oligonucleotide
atgcaaaacaagagagtgtc

SEQ ID NO: 732 - DNA, 20 bp, Artificial sequence
  Synthetic oligonucleotide
aatgcaaaacaagagagtgt

SEQ ID NO: 733 - DNA, 20 bp, Artificial sequence
  Synthetic oligonucleotide
gaatgcaaaacaagagagtg

SEQ ID NO: 734 - DNA, 20 bp, Artificial sequence
  Synthetic oligonucleotide
tgaatgcaaaacaagagagt

SEQ ID NO: 735 - DNA, 20 bp, Artificial sequence
  Synthetic oligonucleotide
ctgaatgcaaaacaagagag

SEQ ID NO: 736 - DNA, 20 bp, Artificial sequence
  Synthetic oligonucleotide
cctgaatgcaaaacaagaga

SEQ ID NO: 737 - DNA, 20 bp, Artificial sequence
  Synthetic oligonucleotide
tcctgaatgcaaaacaagag

SEQ ID NO: 738 - DNA, 20 bp, Artificial sequence
  Synthetic oligonucleotide
ttcctgaatgcaaaacaaga

SEQ ID NO: 739 - DNA, 20 bp, Artificial sequence
  Synthetic oligonucleotide
cttcctgaatgcaaaacaag

SEQ ID NO: 740 - DNA, 20 bp, Artificial sequence
  Synthetic oligonucleotide
ccttcctgaatgcaaaacaa

SEQ ID NO: 741 - DNA, 20 bp, Artificial sequence
  Synthetic oligonucleotide
tccttcctgaatgcaaaaca

SEQ ID NO: 742 - DNA, 20 bp, Artificial sequence
  Synthetic oligonucleotide
ctccttcctgaatgcaaaac

SEQ ID NO: 743 - DNA, 20 bp, Artificial sequence
  Synthetic oligonucleotide
actccttcctgaatgcaaaa

SEQ ID NO: 744 - DNA, 20 bp, Artificial sequence
  Synthetic oligonucleotide
cactccttcctgaatgcaaa

SEQ ID NO: 745 - DNA, 20 bp, Artificial sequence
  Synthetic oligonucleotide
tcactccttcctgaatgcaa

SEQ ID NO: 746 - DNA, 20 bp, Artificial sequence
  Synthetic oligonucleotide
ttcactccttcctgaatgca

SEQ ID NO: 747 - DNA, 20 bp, Artificial sequence
  Synthetic oligonucleotide
tttcactccttcctgaatgc

SEQ ID NO: 748 - DNA, 20 bp, Artificial sequence
  Synthetic oligonucleotide
ttttcactccttcctgaatg

SEQ ID NO: 749 - DNA, 20 bp, Artificial sequence
  Synthetic oligonucleotide
attttcactccttcctgaat

SEQ ID NO: 750 - DNA, 20 bp, Artificial sequence
  Synthetic oligonucleotide
cattttcactccttcctgaa

SEQ ID NO: 751 - DNA, 20 bp, Artificial sequence
  Synthetic oligonucleotide
acattttcactccttcctga

SEQ ID NO: 752 - DNA, 20 bp, Artificial sequence
  Synthetic oligonucleotide
aacattttcactccttcctg

SEQ ID NO: 753 - DNA, 20 bp, Artificial sequence
  Synthetic oligonucleotide
aaacattttcactccttcct

SEQ ID NO: 754 - DNA, 20 bp, Artificial sequence
  Synthetic oligonucleotide
aaaacattttcactccttcc

SEQ ID NO: 755 - DNA, 20 bp, Artificial sequence
  Synthetic oligonucleotide
aaaaacattttcactccttc

SEQ ID NO: 756 - DNA, 20 bp, Artificial sequence
  Synthetic oligonucleotide
taaaaacattttcactcctt

SEQ ID NO: 757 - DNA, 20 bp, Artificial sequence
  Synthetic oligonucleotide
ttaaaaacattttcactcct

SEQ ID NO: 758 - DNA, 20 bp, Artificial sequence
  Synthetic oligonucleotide
tttaaaaacattttcactcc

SEQ ID NO: 759 - DNA, 20 bp, Artificial sequence
  Synthetic oligonucleotide
ctttaaaaacattttcactc

SEQ ID NO: 760 - DNA, 20 bp, Artificial sequence
  Synthetic oligonucleotide
gctttaaaaacattttcact

SEQ ID NO: 761 - DNA, 20 bp, Artificial sequence
  Synthetic oligonucleotide
tgctttaaaaacattttcac

SEQ ID NO: 762 - DNA, 20 bp, Artificial sequence
  Synthetic oligonucleotide
cttgctttaaaaacattttc

SEQ ID NO: 763 - DNA, 20 bp, Artificial sequence
  Synthetic oligonucleotide
cacaaataatttttcttgct

SEQ ID NO: 764 - DNA, 20 bp, Artificial sequence
  Synthetic oligonucleotide
ccacaaataatttttcttgc

SEQ ID NO: 765 - DNA, 20 bp, Artificial sequence
  Synthetic oligonucleotide
tccacaaataatttttcttg

SEQ ID NO: 766 - DNA, 20 bp, Artificial sequence
  Synthetic oligonucleotide
ctgataattccacaaataat

SEQ ID NO: 767 - DNA, 20 bp, Artificial sequence
  Synthetic oligonucleotide
cctgataattccacaaataa

SEQ ID NO: 768 - DNA, 20 bp, Artificial sequence
  Synthetic oligonucleotide
acctgataattccacaaata

SEQ ID NO: 769 - DNA, 20 bp, Artificial sequence
  Synthetic oligonucleotide
cacctgataattccacaaat

SEQ ID NO: 770 - DNA, 20 bp, Artificial sequence
  Synthetic oligonucleotide
tcacctgataattccacaaa

SEQ ID NO: 771 - DNA, 20 bp, Artificial sequence
  Synthetic oligonucleotide
ctcacctgataattccacaa

SEQ ID NO: 772 - DNA, 20 bp, Artificial sequence
  Synthetic oligonucleotide
cctcacctgataattccaca

SEQ ID NO: 773 - DNA, 20 bp, Artificial sequence
  Synthetic oligonucleotide
tcctcacctgataattccac

SEQ ID NO: 774 - DNA, 20 bp, Artificial sequence
  Synthetic oligonucleotide
atcctcacctgataattcca

SEQ ID NO: 775 - DNA, 20 bp, Artificial sequence
  Synthetic oligonucleotide
tatcctcacctgataattcc

SEQ ID NO: 776 - DNA, 20 bp, Artificial sequence
  Synthetic oligonucleotide
atatcctcacctgataattc

SEQ ID NO: 777 - DNA, 20 bp, Artificial sequence
  Synthetic oligonucleotide
aatatcctcacctgataatt

SEQ ID NO: 778 - DNA, 20 bp, Artificial sequence
  Synthetic oligonucleotide
taatatcctcacctgataat

SEQ ID NO: 779 - DNA, 20 bp, Artificial sequence
  Synthetic oligonucleotide
ttaatatcctcacctgataa

SEQ ID NO: 780 - DNA, 20 bp, Artificial sequence
  Synthetic oligonucleotide
cttaatatcctcacctgata

SEQ ID NO: 781 - DNA, 20 bp, Artificial sequence
  Synthetic oligonucleotide
ccttaatatcctcacctgat

SEQ ID NO: 782 - DNA, 20 bp, Artificial sequence
  Synthetic oligonucleotide
tccttaatatcctcacctga

SEQ ID NO: 783 - DNA, 20 bp, Artificial sequence
  Synthetic oligonucleotide
ttccttaatatcctcacctg

SEQ ID NO: 784 - DNA, 20 bp, Artificial sequence
  Synthetic oligonucleotide
attccttaatatcctcacct

SEQ ID NO: 785 - DNA, 20 bp, Artificial sequence
  Synthetic oligonucleotide
aattccttaatatcctcacc

SEQ ID NO: 786 - DNA, 20 bp, Artificial sequence
  Synthetic oligonucleotide
aaattccttaatatcctcac

SEQ ID NO: 787 - DNA, 20 bp, Artificial sequence
  Synthetic oligonucleotide
taaattccttaatatcctca

SEQ ID NO: 788 - DNA, 20 bp, Artificial sequence
  Synthetic oligonucleotide
ctaaattccttaatatcctc

SEQ ID NO: 789 - DNA, 20 bp, Artificial sequence
  Synthetic oligonucleotide
actaaattccttaatatcct

SEQ ID NO: 790 - DNA, 20 bp, Artificial sequence
  Synthetic oligonucleotide
cactaaattccttaatatcc

SEQ ID NO: 791 - DNA, 20 bp, Artificial sequence
  Synthetic oligonucleotide
tcactaaattccttaatatc

SEQ ID NO: 792 - DNA, 20 bp, Artificial sequence
  Synthetic oligonucleotide
cttcactaaattccttaata

SEQ ID NO: 793 - DNA, 20 bp, Artificial sequence
  Synthetic oligonucleotide
tcttcactaaattccttaat

SEQ ID NO: 794 - DNA, 20 bp, Artificial sequence
  Synthetic oligonucleotide
atcttcactaaattccttaa

SEQ ID NO: 795 - DNA, 20 bp, Artificial sequence
  Synthetic oligonucleotide
tatcttcactaaattcctta

SEQ ID NO: 796 - DNA, 20 bp, Artificial sequence
  Synthetic oligonucleotide
ttatcttcactaaattcctt

SEQ ID NO: 797 - DNA, 20 bp, Artificial sequence
  Synthetic oligonucleotide
attatcttcactaaattcct

SEQ ID NO: 798 - DNA, 20 bp, Artificial sequence
  Synthetic oligonucleotide
cattatcttcactaaattcc

SEQ ID NO: 799 - DNA, 20 bp, Artificial sequence
  Synthetic oligonucleotide
ccattatcttcactaaattc

SEQ ID NO: 800 - DNA, 20 bp, Artificial sequence
  Synthetic oligonucleotide
accattatcttcactaaatt

SEQ ID NO: 801 - DNA, 20 bp, Artificial sequence
  Synthetic oligonucleotide
aaccattatcttcactaaat

SEQ ID NO: 802 - DNA, 20 bp, Artificial sequence
  Synthetic oligonucleotide
aaaccattatcttcactaaa

SEQ ID NO: 803 - DNA, 20 bp, Artificial sequence
  Synthetic oligonucleotide
aaaaccattatcttcactaa

SEQ ID NO: 804 - DNA, 20 bp, Artificial sequence
  Synthetic oligonucleotide
taaaaccattatcttcacta

SEQ ID NO: 805 - DNA, 20 bp, Artificial sequence
  Synthetic oligonucleotide
ctaaaaccattatcttcact

SEQ ID NO: 806 - DNA, 20 bp, Artificial sequence
  Synthetic oligonucleotide
actaaaaccattatcttcac

SEQ ID NO: 807 - DNA, 20 bp, Artificial sequence
  Synthetic oligonucleotide
aactaaaaccattatcttca

SEQ ID NO: 808 - DNA, 20 bp, Artificial sequence
  Synthetic oligonucleotide
aaactaaaaccattatcttc

SEQ ID NO: 809 - DNA, 20 bp, Artificial sequence
  Synthetic oligonucleotide
catcaaataaactaaaacca

SEQ ID NO: 810 - DNA, 20 bp, Artificial sequence
  Synthetic oligonucleotide
gcatcaaataaactaaaacc

SEQ ID NO: 811 - DNA, 20 bp, Artificial sequence
  Synthetic oligonucleotide
agcatcaaataaactaaaac

SEQ ID NO: 812 - DNA, 20 bp, Artificial sequence
  Synthetic oligonucleotide
gtagcatcaaataaactaaa

SEQ ID NO: 813 - DNA, 20 bp, Artificial sequence
  Synthetic oligonucleotide
agtagcatcaaataaactaa

SEQ ID NO: 814 - DNA, 20 bp, Artificial sequence
  Synthetic oligonucleotide
gagtagcatcaaataaacta

SEQ ID NO: 815 - DNA, 20 bp, Artificial sequence
  Synthetic oligonucleotide
agagtagcatcaaataaact

SEQ ID NO: 816 - DNA, 20 bp, Artificial sequence
  Synthetic oligonucleotide
aagagtagcatcaaataaac

SEQ ID NO: 817 - DNA, 20 bp, Artificial sequence
  Synthetic oligonucleotide
gaagagtagcatcaaataaa

SEQ ID NO: 818 - DNA, 20 bp, Artificial sequence
  Synthetic oligonucleotide
tgaagagtagcatcaaataa

SEQ ID NO: 819 - DNA, 20 bp, Artificial sequence
  Synthetic oligonucleotide
ctgaagagtagcatcaaata

SEQ ID NO: 820 - DNA, 20 bp, Artificial sequence
  Synthetic oligonucleotide
tctgaagagtagcatcaaat

SEQ ID NO: 821 - DNA, 20 bp, Artificial sequence
  Synthetic oligonucleotide
ttctgaagagtagcatcaaa

SEQ ID NO: 822 - DNA, 20 bp, Artificial sequence
  Synthetic oligonucleotide
cttctgaagagtagcatcaa

SEQ ID NO: 823 - DNA, 20 bp, Artificial sequence
  Synthetic oligonucleotide
acacgcttctgaagagtagc

SEQ ID NO: 824 - DNA, 20 bp, Artificial sequence
  Synthetic oligonucleotide
cacacgcttctgaagagtag

SEQ ID NO: 825 - DNA, 20 bp, Artificial sequence
  Synthetic oligonucleotide
tcacacgcttctgaagagta

SEQ ID NO: 826 - DNA, 20 bp, Artificial sequence
  Synthetic oligonucleotide
agtcacacgcttctgaagag

SEQ ID NO: 827 - DNA, 20 bp, Artificial sequence
  Synthetic oligonucleotide
aagtcacacgcttctgaaga

SEQ ID NO: 828 - DNA, 20 bp, Artificial sequence
  Synthetic oligonucleotide
tcatcggaagtcacacgctt

SEQ ID NO: 829 - DNA, 20 bp, Artificial sequence
  Synthetic oligonucleotide
ctcatcggaagtcacacgct

SEQ ID NO: 830 - DNA, 20 bp, Artificial sequence
  Synthetic oligonucleotide
tctcatcggaagtcacacgc

SEQ ID NO: 831 - DNA, 20 bp, Artificial sequence
  Synthetic oligonucleotide
ctctcatcggaagtcacacg

SEQ ID NO: 832 - DNA, 20 bp, Artificial sequence
  Synthetic oligonucleotide
cctctcatcggaagtcacac

SEQ ID NO: 833 - DNA, 20 bp, Artificial sequence
  Synthetic oligonucleotide
tcctctcatcggaagtcaca

SEQ ID NO: 834 - DNA, 20 bp, Artificial sequence
  Synthetic oligonucleotide
ctcctctcatcggaagtcac

SEQ ID NO: 835 - DNA, 20 bp, Artificial sequence
  Synthetic oligonucleotide
gctcctctcatcggaagtca

SEQ ID NO: 836 - DNA, 20 bp, Artificial sequence
  Synthetic oligonucleotide
tgctcctctcatcggaagtc

SEQ ID NO: 837 - DNA, 20 bp, Artificial sequence
  Synthetic oligonucleotide
ttgctcctctcatcggaagt

SEQ ID NO: 838 - DNA, 20 bp, Artificial sequence
  Synthetic oligonucleotide
attgctcctctcatcggaag

SEQ ID NO: 839 - DNA, 20 bp, Artificial sequence
  Synthetic oligonucleotide
aattgctcctctcatcggaa

SEQ ID NO: 840 - DNA, 20 bp, Artificial sequence
  Synthetic oligonucleotide
aaattgctcctctcatcgga

SEQ ID NO: 841 - DNA, 20 bp, Artificial sequence
  Synthetic oligonucleotide
gaaattgctcctctcatcgg

SEQ ID NO: 842 - DNA, 20 bp, Artificial sequence
  Synthetic oligonucleotide
ggaaattgctcctctcatcg

SEQ ID NO: 843 - DNA, 20 bp, Artificial sequence
  Synthetic oligonucleotide
tggaaattgctcctctcatc

SEQ ID NO: 844 - DNA, 20 bp, Artificial sequence
  Synthetic oligonucleotide
ctggaaattgctcctctcat

SEQ ID NO: 845 - DNA, 20 bp, Artificial sequence
  Synthetic oligonucleotide
cctggaaattgctcctctca

SEQ ID NO: 846 - DNA, 20 bp, Artificial sequence
  Synthetic oligonucleotide
tcctggaaattgctcctctc

SEQ ID NO: 847 - DNA, 20 bp, Artificial sequence
  Synthetic oligonucleotide
ttcctggaaattgctcctct

SEQ ID NO: 848 - DNA, 20 bp, Artificial sequence
  Synthetic oligonucleotide
cttcctggaaattgctcctc

SEQ ID NO: 849 - DNA, 20 bp, Artificial sequence
  Synthetic oligonucleotide
gcttcctggaaattgctcct

SEQ ID NO: 850 - DNA, 20 bp, Artificial sequence
  Synthetic oligonucleotide
tgcttcctggaaattgctcc

SEQ ID NO: 851 - DNA, 20 bp, Artificial sequence
  Synthetic oligonucleotide
atgcttcctggaaattgctc

SEQ ID NO: 852 - DNA, 20 bp, Artificial sequence
  Synthetic oligonucleotide
catgcttcctggaaattgct

SEQ ID NO: 853 - DNA, 20 bp, Artificial sequence
  Synthetic oligonucleotide
acatgcttcctggaaattgc

SEQ ID NO: 854 - DNA, 20 bp, Artificial sequence
  Synthetic oligonucleotide
tacatgcttcctggaaattg

SEQ ID NO: 855 - DNA, 20 bp, Artificial sequence
  Synthetic oligonucleotide
ttacatgcttcctggaaatt

SEQ ID NO: 856 - DNA, 20 bp, Artificial sequence
  Synthetic oligonucleotide
attacatgcttcctggaaat

SEQ ID NO: 857 - DNA, 20 bp, Artificial sequence
  Synthetic oligonucleotide
tattacatgcttcctggaaa

SEQ ID NO: 858 - DNA, 20 bp, Artificial sequence
  Synthetic oligonucleotide
ttattacatgcttcctggaa

SEQ ID NO: 859 - DNA, 20 bp, Artificial sequence
  Synthetic oligonucleotide
attattacatgcttcctgga

SEQ ID NO: 860 - DNA, 20 bp, Artificial sequence
  Synthetic oligonucleotide
tattattacatgcttcctgg

SEQ ID NO: 861 - DNA, 20 bp, Artificial sequence
  Synthetic oligonucleotide
atattattacatgcttcctg

SEQ ID NO: 862 - DNA, 20 bp, Artificial sequence
  Synthetic oligonucleotide
aatattattacatgcttcct

SEQ ID NO: 863 - DNA, 20 bp, Artificial sequence
  Synthetic oligonucleotide
aaatattattacatgcttcc

SEQ ID NO: 864 - DNA, 20 bp, Artificial sequence
  Synthetic oligonucleotide
ctcataggaatctaaaatat

SEQ ID NO: 865 - DNA, 20 bp, Artificial sequence
  Synthetic oligonucleotide
tctcataggaatctaaaata

SEQ ID NO: 866 - DNA, 20 bp, Artificial sequence
  Synthetic oligonucleotide
atctcataggaatctaaaat

SEQ ID NO: 867 - DNA, 20 bp, Artificial sequence
  Synthetic oligonucleotide
catctcataggaatctaaaa

SEQ ID NO: 868 - DNA, 20 bp, Artificial sequence
  Synthetic oligonucleotide
acatctcataggaatctaaa

SEQ ID NO: 869 - DNA, 20 bp, Artificial sequence
  Synthetic oligonucleotide
aacatctcataggaatctaa

SEQ ID NO: 870 - DNA, 20 bp, Artificial sequence
  Synthetic oligonucleotide
aaacatctcataggaatcta

SEQ ID NO: 871 - DNA, 20 bp, Artificial sequence
  Synthetic oligonucleotide
taaacatctcataggaatct

SEQ ID NO: 872 - DNA, 20 bp, Artificial sequence
  Synthetic oligonucleotide
ttaaacatctcataggaatc

SEQ ID NO: 873 - DNA, 20 bp, Artificial sequence
  Synthetic oligonucleotide
attaaacatctcataggaat

SEQ ID NO: 874 - DNA, 20 bp, Artificial sequence
  Synthetic oligonucleotide
aattaaacatctcataggaa

SEQ ID NO: 875 - DNA, 20 bp, Artificial sequence
  Synthetic oligonucleotide
aaattaaacatctcatagga

SEQ ID NO: 876 - DNA, 20 bp, Artificial sequence
  Synthetic oligonucleotide
caaattaaacatctcatagg

SEQ ID NO: 877 - DNA, 20 bp, Artificial sequence
  Synthetic oligonucleotide
gcaaattaaacatctcatag

SEQ ID NO: 878 - DNA, 20 bp, Artificial sequence
  Synthetic oligonucleotide
tgcaaattaaacatctcata

SEQ ID NO: 879 - DNA, 20 bp, Artificial sequence
  Synthetic oligonucleotide
ctgcaaattaaacatctcat

SEQ ID NO: 880 - DNA, 20 bp, Artificial sequence
  Synthetic oligonucleotide
actgcaaattaaacatctca

SEQ ID NO: 881 - DNA, 20 bp, Artificial sequence
  Synthetic oligonucleotide
gactgcaaattaaacatctc

SEQ ID NO: 882 - DNA, 20 bp, Artificial sequence
  Synthetic oligonucleotide
tgactgcaaattaaacatct

SEQ ID NO: 883 - DNA, 20 bp, Artificial sequence
  Synthetic oligonucleotide
ttgactgcaaattaaacatc

SEQ ID NO: 884 - DNA, 20 bp, Artificial sequence
  Synthetic oligonucleotide
tttgactgcaaattaaacat

SEQ ID NO: 885 - DNA, 20 bp, Artificial sequence
  Synthetic oligonucleotide
tcttttcacagcttttgact

SEQ ID NO: 886 - DNA, 20 bp, Artificial sequence
  Synthetic oligonucleotide
ttcttttcacagcttttgac

SEQ ID NO: 887 - DNA, 20 bp, Artificial sequence
  Synthetic oligonucleotide
tttcttttcacagcttttga

SEQ ID NO: 888 - DNA, 20 bp, Artificial sequence
  Synthetic oligonucleotide
ttttcttttcacagcttttg

SEQ ID NO: 889 - DNA, 20 bp, Artificial sequence
  Synthetic oligonucleotide
tttttcttttcacagctttt

SEQ ID NO: 890 - DNA, 20 bp, Artificial sequence
  Synthetic oligonucleotide
gtttttcttttcacagcttt

SEQ ID NO: 891 - DNA, 20 bp, Artificial sequence
  Synthetic oligonucleotide
agtttttcttttcacagctt

SEQ ID NO: 892 - DNA, 20 bp, Artificial sequence
  Synthetic oligonucleotide
tagtttttcttttcacagct

SEQ ID NO: 893 - DNA, 20 bp, Artificial sequence
  Synthetic oligonucleotide
gtagtttttcttttcacagc

SEQ ID NO: 894 - DNA, 20 bp, Artificial sequence
  Synthetic oligonucleotide
agtagtttttcttttcacag

SEQ ID NO: 895 - DNA, 20 bp, Artificial sequence
  Synthetic oligonucleotide
cagtagtttttcttttcaca

SEQ ID NO: 896 - DNA, 20 bp, Artificial sequence
  Synthetic oligonucleotide
gcagtagtttttcttttcac

SEQ ID NO: 897 - DNA, 20 bp, Artificial sequence
  Synthetic oligonucleotide
tgcagtagtttttcttttca

SEQ ID NO: 898 - DNA, 20 bp, Artificial sequence
  Synthetic oligonucleotide
ctgcagtagtttttcttttc

SEQ ID NO: 899 - DNA, 20 bp, Artificial sequence
  Synthetic oligonucleotide
tctgcagtagtttttctttt

SEQ ID NO: 900 - DNA, 20 bp, Artificial sequence
  Synthetic oligonucleotide
ttctgcagtagtttttcttt

SEQ ID NO: 901 - DNA, 20 bp, Artificial sequence
  Synthetic oligonucleotide
tttctgcagtagtttttctt

SEQ ID NO: 902 - DNA, 20 bp, Artificial sequence
  Synthetic oligonucleotide
ttttctgcagtagtttttct

SEQ ID NO: 903 - DNA, 20 bp, Artificial sequence
  Synthetic oligonucleotide
gttttctgcagtagtttttc

SEQ ID NO: 904 - DNA, 20 bp, Artificial sequence
  Synthetic oligonucleotide
cgttttctgcagtagttttt

SEQ ID NO: 905 - DNA, 20 bp, Artificial sequence
  Synthetic oligonucleotide
acgttttctgcagtagtttt

SEQ ID NO: 906 - DNA, 20 bp, Artificial sequence
  Synthetic oligonucleotide
tacgttttctgcagtagttt

SEQ ID NO: 907 - DNA, 20 bp, Artificial sequence
  Synthetic oligonucleotide
ttacgttttctgcagtagtt

SEQ ID NO: 908 - DNA, 20 bp, Artificial sequence
  Synthetic oligonucleotide
tttacgttttctgcagtagt

SEQ ID NO: 909 - DNA, 20 bp, Artificial sequence
  Synthetic oligonucleotide
gtttacgttttctgcagtag

SEQ ID NO: 910 - DNA, 20 bp, Artificial sequence
  Synthetic oligonucleotide
tgtttacgttttctgcagta

SEQ ID NO: 911 - DNA, 20 bp, Artificial sequence
  Synthetic oligonucleotide
gtgtttacgttttctgcagt

SEQ ID NO: 912 - DNA, 20 bp, Artificial sequence
  Synthetic oligonucleotide
tgtgtttacgttttctgcag

SEQ ID NO: 913 - DNA, 20 bp, Artificial sequence
  Synthetic oligonucleotide
gtgtgtttacgttttctgca

SEQ ID NO: 914 - DNA, 20 bp, Artificial sequence
  Synthetic oligonucleotide
tgtgtgtttacgttttctgc

SEQ ID NO: 915 - DNA, 20 bp, Artificial sequence
  Synthetic oligonucleotide
ctgtgtgtttacgttttctg

SEQ ID NO: 916 - DNA, 20 bp, Artificial sequence
  Synthetic oligonucleotide
tctgtgtgtttacgttttct

SEQ ID NO: 917 - DNA, 20 bp, Artificial sequence
  Synthetic oligonucleotide
ctctgtgtgtttacgttttc

SEQ ID NO: 918 - DNA, 20 bp, Artificial sequence
  Synthetic oligonucleotide
actctgtgtgtttacgtttt

SEQ ID NO: 919 - DNA, 20 bp, Artificial sequence
  Synthetic oligonucleotide
aactctgtgtgtttacgttt

SEQ ID NO: 920 - DNA, 20 bp, Artificial sequence
  Synthetic oligonucleotide
gaactctgtgtgtttacgtt

SEQ ID NO: 921 - DNA, 20 bp, Artificial sequence
  Synthetic oligonucleotide
agaactctgtgtgtttacgt

SEQ ID NO: 922 - DNA, 20 bp, Artificial sequence
  Synthetic oligonucleotide
tagaactctgtgtgtttacg

SEQ ID NO: 923 - DNA, 20 bp, Artificial sequence
  Synthetic oligonucleotide
ctagaactctgtgtgtttac

SEQ ID NO: 924 - DNA, 20 bp, Artificial sequence
  Synthetic oligonucleotide
cctagaactctgtgtgttta

SEQ ID NO: 925 - DNA, 20 bp, Artificial sequence
  Synthetic oligonucleotide
ccctagaactctgtgtgttt

SEQ ID NO: 926 - DNA, 20 bp, Artificial sequence
  Synthetic oligonucleotide
tccctagaactctgtgtgtt

SEQ ID NO: 927 - DNA, 20 bp, Artificial sequence
  Synthetic oligonucleotide
atccctagaactctgtgtgt

SEQ ID NO: 928 - DNA, 20 bp, Artificial sequence
  Synthetic oligonucleotide
aatccctagaactctgtgtg

SEQ ID NO: 929 - DNA, 20 bp, Artificial sequence
  Synthetic oligonucleotide
gaatccctagaactctgtgt

SEQ ID NO: 930 - DNA, 20 bp, Artificial sequence
  Synthetic oligonucleotide
tgaatccctagaactctgtg

SEQ ID NO: 931 - DNA, 20 bp, Artificial sequence
  Synthetic oligonucleotide
ctgaatccctagaactctgt

SEQ ID NO: 932 - DNA, 20 bp, Artificial sequence
  Synthetic oligonucleotide
tctgaatccctagaactctg

SEQ ID NO: 933 - DNA, 20 bp, Artificial sequence
  Synthetic oligonucleotide
ttctgaatccctagaactct

SEQ ID NO: 934 - DNA, 20 bp, Artificial sequence
  Synthetic oligonucleotide
cttctgaatccctagaactc

SEQ ID NO: 935 - DNA, 20 bp, Artificial sequence
  Synthetic oligonucleotide
gcttctgaatccctagaact

SEQ ID NO: 936 - DNA, 20 bp, Artificial sequence
  Synthetic oligonucleotide
agcttctgaatccctagaac

SEQ ID NO: 937 - DNA, 20 bp, Artificial sequence
  Synthetic oligonucleotide
tagcttctgaatccctagaa

SEQ ID NO: 938 - DNA, 20 bp, Artificial sequence
  Synthetic oligonucleotide
gtagcttctgaatccctaga

SEQ ID NO: 939 - DNA, 20 bp, Artificial sequence
  Synthetic oligonucleotide
ggtagcttctgaatccctag

SEQ ID NO: 940 - DNA, 20 bp, Artificial sequence
  Synthetic oligonucleotide
tggtagcttctgaatcccta

SEQ ID NO: 941 - DNA, 20 bp, Artificial sequence
  Synthetic oligonucleotide
ctggtagcttctgaatccct

SEQ ID NO: 942 - DNA, 20 bp, Artificial sequence
  Synthetic oligonucleotide
tctggtagcttctgaatccc

SEQ ID NO: 943 - DNA, 20 bp, Artificial sequence
  Synthetic oligonucleotide
ttctggtagcttctgaatcc

SEQ ID NO: 944 - DNA, 20 bp, Artificial sequence
  Synthetic oligonucleotide
tttctggtagcttctgaatc

SEQ ID NO: 945 - DNA, 20 bp, Artificial sequence
  Synthetic oligonucleotide
ttttctggtagcttctgaat

SEQ ID NO: 946 - DNA, 20 bp, Artificial sequence
  Synthetic oligonucleotide
tttttctggtagcttctgaa

SEQ ID NO: 947 - DNA, 20 bp, Artificial sequence
  Synthetic oligonucleotide
atgtacaaaaatgcatcatt

SEQ ID NO: 948 - DNA, 20 bp, Artificial sequence
  Synthetic oligonucleotide
aatgtacaaaaatgcatcat

SEQ ID NO: 949 - DNA, 20 bp, Artificial sequence
  Synthetic oligonucleotide
aaatgtacaaaaatgcatca

SEQ ID NO: 950 - DNA, 20 bp, Artificial sequence
  Synthetic oligonucleotide
taaatgtacaaaaatgcatc

SEQ ID NO: 951 - DNA, 20 bp, Artificial sequence
  Synthetic oligonucleotide
cataaatgtacaaaaatgca

SEQ ID NO: 952 - DNA, 20 bp, Artificial sequence
  Synthetic oligonucleotide
tcataaatgtacaaaaatgc

SEQ ID NO: 953 - DNA, 20 bp, Artificial sequence
  Synthetic oligonucleotide
ctgattcataaatgtacaaa

SEQ ID NO: 954 - DNA, 20 bp, Artificial sequence
  Synthetic oligonucleotide
cctgattcataaatgtacaa

SEQ ID NO: 955 - DNA, 20 bp, Artificial sequence
  Synthetic oligonucleotide
acctgattcataaatgtaca

SEQ ID NO: 956 - DNA, 20 bp, Artificial sequence
  Synthetic oligonucleotide
cacctgattcataaatgtac

SEQ ID NO: 957 - DNA, 20 bp, Artificial sequence
  Synthetic oligonucleotide
ccacctgattcataaatgta

SEQ ID NO: 958 - DNA, 20 bp, Artificial sequence
  Synthetic oligonucleotide
accacctgattcataaatgt

SEQ ID NO: 959 - DNA, 20 bp, Artificial sequence
  Synthetic oligonucleotide
gaccacctgattcataaatg

SEQ ID NO: 960 - DNA, 20 bp, Artificial sequence
  Synthetic oligonucleotide
ggaccacctgattcataaat

SEQ ID NO: 961 - DNA, 20 bp, Artificial sequence
  Synthetic oligonucleotide
ctggaccacctgattcataa

SEQ ID NO: 962 - DNA, 20 bp, Artificial sequence
  Synthetic oligonucleotide
cctggaccacctgattcata

SEQ ID NO: 963 - DNA, 20 bp, Artificial sequence
  Synthetic oligonucleotide
gcctggaccacctgattcat

SEQ ID NO: 964 - DNA, 20 bp, Artificial sequence
  Synthetic oligonucleotide
gctctgtcattttgctatgg

SEQ ID NO: 965 - DNA, 20 bp, Artificial sequence
  Synthetic oligonucleotide
ggctctgtcattttgctatg

SEQ ID NO: 966 - DNA, 20 bp, Artificial sequence
  Synthetic oligonucleotide
tggctctgtcattttgctat

SEQ ID NO: 967 - DNA, 20 bp, Artificial sequence
  Synthetic oligonucleotide
atggctctgtcattttgcta

SEQ ID NO: 968 - DNA, 20 bp, Artificial sequence
  Synthetic oligonucleotide
gatggctctgtcattttgct

SEQ ID NO: 969 - DNA, 20 bp, Artificial sequence
  Synthetic oligonucleotide
agatggctctgtcattttgc

SEQ ID NO: 970 - DNA, 20 bp, Artificial sequence
  Synthetic oligonucleotide
aagatggctctgtcattttg

SEQ ID NO: 971 - DNA, 20 bp, Artificial sequence
  Synthetic oligonucleotide
aaagatggctctgtcatttt

SEQ ID NO: 972 - DNA, 20 bp, Artificial sequence
  Synthetic oligonucleotide
taaagatggctctgtcattt

SEQ ID NO: 973 - DNA, 20 bp, Artificial sequence
  Synthetic oligonucleotide
gtaaagatggctctgtcatt

SEQ ID NO: 974 - DNA, 20 bp, Artificial sequence
  Synthetic oligonucleotide
tgtaaagatggctctgtcat

SEQ ID NO: 975 - DNA, 20 bp, Artificial sequence
  Synthetic oligonucleotide
ttgtaaagatggctctgtca

SEQ ID NO: 976 - DNA, 20 bp, Artificial sequence
  Synthetic oligonucleotide
tttgtaaagatggctctgtc

SEQ ID NO: 977 - DNA, 20 bp, Artificial sequence
  Synthetic oligonucleotide
ttttgtaaagatggctctgt

SEQ ID NO: 978 - DNA, 20 bp, Artificial sequence
  Synthetic oligonucleotide
gttttgtaaagatggctctg

SEQ ID NO: 979 - DNA, 20 bp, Artificial sequence
  Synthetic oligonucleotide
tgttttgtaaagatggctct

SEQ ID NO: 980 - DNA, 20 bp, Artificial sequence
  Synthetic oligonucleotide
ttgttttgtaaagatggctc

SEQ ID NO: 981 - DNA, 20 bp, Artificial sequence
  Synthetic oligonucleotide
tttgttttgtaaagatggct

SEQ ID NO: 982 - DNA, 20 bp, Artificial sequence
  Synthetic oligonucleotide
ctttgttttgtaaagatggc

SEQ ID NO: 983 - DNA, 20 bp, Artificial sequence
  Synthetic oligonucleotide
tctttgttttgtaaagatgg

SEQ ID NO: 984 - DNA, 20 bp, Artificial sequence
  Synthetic oligonucleotide
gctgtctttgttttgtaaag

SEQ ID NO: 985 - DNA, 20 bp, Artificial sequence
  Synthetic oligonucleotide
agctgtctttgttttgtaaa

SEQ ID NO: 986 - DNA, 20 bp, Artificial sequence
  Synthetic oligonucleotide
gagctgtctttgttttgtaa

SEQ ID NO: 987 - DNA, 20 bp, Artificial sequence
  Synthetic oligonucleotide
agagctgtctttgttttgta

SEQ ID NO: 988 - DNA, 20 bp, Artificial sequence
  Synthetic oligonucleotide
aagagctgtctttgttttgt

SEQ ID NO: 989 - DNA, 20 bp, Artificial sequence
  Synthetic oligonucleotide
ctttgattctgagcaagagc

SEQ ID NO: 990 - DNA, 20 bp, Artificial sequence
  Synthetic oligonucleotide
tctttgattctgagcaagag

SEQ ID NO: 991 - DNA, 20 bp, Artificial sequence
  Synthetic oligonucleotide
atctttgattctgagcaaga

SEQ ID NO: 992 - DNA, 20 bp, Artificial sequence
  Synthetic oligonucleotide
catctttgattctgagcaag

SEQ ID NO: 993 - DNA, 20 bp, Artificial sequence
  Synthetic oligonucleotide
acatctttgattctgagcaa

SEQ ID NO: 994 - DNA, 20 bp, Artificial sequence
  Synthetic oligonucleotide
aacatctttgattctgagca

SEQ ID NO: 995 - DNA, 20 bp, Artificial sequence
  Synthetic oligonucleotide
taacatctttgattctgagc

SEQ ID NO: 996 - DNA, 20 bp, Artificial sequence
  Synthetic oligonucleotide
ctaacatctttgattctgag

SEQ ID NO: 997 - DNA, 20 bp, Artificial sequence
  Synthetic oligonucleotide
tctaacatctttgattctga

SEQ ID NO: 998 - DNA, 20 bp, Artificial sequence
  Synthetic oligonucleotide
ttctaacatctttgattctg

SEQ ID NO: 999 - DNA, 20 bp, Artificial sequence
  Synthetic oligonucleotide
gttctaacatctttgattct

SEQ ID NO: 1000 - DNA, 20 bp, Artificial sequence
  Synthetic oligonucleotide
tgttctaacatctttgattc

SEQ ID NO: 1001 - DNA, 20 bp, Artificial sequence
  Synthetic oligonucleotide
aattgtctcttgttctaaca

SEQ ID NO: 1002 - DNA, 20 bp, Artificial sequence
  Synthetic oligonucleotide
caattgtctcttgttctaac

SEQ ID NO: 1003 - DNA, 20 bp, Artificial sequence
  Synthetic oligonucleotide
acaattgtctcttgttctaa

SEQ ID NO: 1004 - DNA, 20 bp, Artificial sequence
  Synthetic oligonucleotide
tacaattgtctcttgttcta

SEQ ID NO: 1005 - DNA, 20 bp, Artificial sequence
  Synthetic oligonucleotide
ctacaattgtctcttgttct

SEQ ID NO: 1006 - DNA, 20 bp, Artificial sequence
  Synthetic oligonucleotide
gctacaattgtctcttgttc

SEQ ID NO: 1007 - DNA, 20 bp, Artificial sequence
  Synthetic oligonucleotide
tgctacaattgtctcttgtt

SEQ ID NO: 1008 - DNA, 20 bp, Artificial sequence
  Synthetic oligonucleotide
gatgctacaattgtctcttg

SEQ ID NO: 1009 - DNA, 20 bp, Artificial sequence
  Synthetic oligonucleotide
tgatgctacaattgtctctt

SEQ ID NO: 1010 - DNA, 20 bp, Artificial sequence
  Synthetic oligonucleotide
ctgatgctacaattgtctct

SEQ ID NO: 1011 - DNA, 20 bp, Artificial sequence
  Synthetic oligonucleotide
tctgatgctacaattgtctc

SEQ ID NO: 1012 - DNA, 20 bp, Artificial sequence
  Synthetic oligonucleotide
ttctgatgctacaattgtct

SEQ ID NO: 1013 - DNA, 20 bp, Artificial sequence
  Synthetic oligonucleotide
cttctgatgctacaattgtc

SEQ ID NO: 1014 - DNA, 20 bp, Artificial sequence
  Synthetic oligonucleotide
gcttctgatgctacaattgt

SEQ ID NO: 1015 - DNA, 20 bp, Artificial sequence
  Synthetic oligonucleotide
cagcttctgatgctacaatt

SEQ ID NO: 1016 - DNA, 20 bp, Artificial sequence
  Synthetic oligonucleotide
ccagcttctgatgctacaat

SEQ ID NO: 1017 - DNA, 20 bp, Artificial sequence
  Synthetic oligonucleotide
tccagcttctgatgctacaa

SEQ ID NO: 1018 - DNA, 20 bp, Artificial sequence
  Synthetic oligonucleotide
ctccagcttctgatgctaca

SEQ ID NO: 1019 - DNA, 20 bp, Artificial sequence
  Synthetic oligonucleotide
tctccagcttctgatgctac

SEQ ID NO: 1020 - DNA, 20 bp, Artificial sequence
  Synthetic oligonucleotide
ttctccagcttctgatgcta

SEQ ID NO: 1021 - DNA, 20 bp, Artificial sequence
  Synthetic oligonucleotide
ttttctccagcttctgatgc

SEQ ID NO: 1022 - DNA, 20 bp, Artificial sequence
  Synthetic oligonucleotide
attttctccagcttctgatg

SEQ ID NO: 1023 - DNA, 20 bp, Artificial sequence
  Synthetic oligonucleotide
cattttctccagcttctgat

SEQ ID NO: 1024 - DNA, 20 bp, Artificial sequence
  Synthetic oligonucleotide
tcattttctccagcttctga

SEQ ID NO: 1025 - DNA, 20 bp, Artificial sequence
  Synthetic oligonucleotide
ctcattttctccagcttctg

SEQ ID NO: 1026 - DNA, 20 bp, Artificial sequence
  Synthetic oligonucleotide
tctcattttctccagcttct

SEQ ID NO: 1027 - DNA, 20 bp, Artificial sequence
  Synthetic oligonucleotide
ttctcattttctccagcttc

SEQ ID NO: 1028 - DNA, 20 bp, Artificial sequence
  Synthetic oligonucleotide
tttctcattttctccagctt

SEQ ID NO: 1029 - DNA, 20 bp, Artificial sequence
  Synthetic oligonucleotide
gtttctcattttctccagct

SEQ ID NO: 1030 - DNA, 20 bp, Artificial sequence
  Synthetic oligonucleotide
tgtttctcattttctccagc

SEQ ID NO: 1031 - DNA, 20 bp, Artificial sequence
  Synthetic oligonucleotide
atgtttctcattttctccag

SEQ ID NO: 1032 - DNA, 20 bp, Artificial sequence
  Synthetic oligonucleotide
tatgtttctcattttctcca

SEQ ID NO: 1033 - DNA, 20 bp, Artificial sequence
  Synthetic oligonucleotide
ttatgtttctcattttctcc

SEQ ID NO: 1034 - DNA, 20 bp, Artificial sequence
  Synthetic oligonucleotide
tttatgtttctcattttctc

SEQ ID NO: 1035 - DNA, 20 bp, Artificial sequence
  Synthetic oligonucleotide
atgttccaggaaagattttt

SEQ ID NO: 1036 - DNA, 20 bp, Artificial sequence
  Synthetic oligonucleotide
tatgttccaggaaagatttt

SEQ ID NO: 1037 - DNA, 20 bp, Artificial sequence
  Synthetic oligonucleotide
ctatgttccaggaaagattt

SEQ ID NO: 1038 - DNA, 20 bp, Artificial sequence
  Synthetic oligonucleotide
gctatgttccaggaaagatt

SEQ ID NO: 1039 - DNA, 20 bp, Artificial sequence
  Synthetic oligonucleotide
agctatgttccaggaaagat

SEQ ID NO: 1040 - DNA, 20 bp, Artificial sequence
  Synthetic oligonucleotide
gagctatgttccaggaaaga

SEQ ID NO: 1041 - DNA, 20 bp, Artificial sequence
  Synthetic oligonucleotide
agagctatgttccaggaaag

SEQ ID NO: 1042 - DNA, 20 bp, Artificial sequence
  Synthetic oligonucleotide
aagagctatgttccaggaaa

SEQ ID NO: 1043 - DNA, 20 bp, Artificial sequence
  Synthetic oligonucleotide
aaagagctatgttccaggaa

SEQ ID NO: 1044 - DNA, 20 bp, Artificial sequence
  Synthetic oligonucleotide
taaagagctatgttccagga

SEQ ID NO: 1045 - DNA, 20 bp, Artificial sequence
  Synthetic oligonucleotide
ctaaagagctatgttccagg

SEQ ID NO: 1046 - DNA, 20 bp, Artificial sequence
  Synthetic oligonucleotide
tctaaagagctatgttccag

SEQ ID NO: 1047 - DNA, 20 bp, Artificial sequence
  Synthetic oligonucleotide
ttctaaagagctatgttcca

SEQ ID NO: 1048 - DNA, 20 bp, Artificial sequence
  Synthetic oligonucleotide
tttctaaagagctatgttcc

SEQ ID NO: 1049 - DNA, 20 bp, Artificial sequence
  Synthetic oligonucleotide
ttttctaaagagctatgttc

SEQ ID NO: 1050 - DNA, 20 bp, Artificial sequence
  Synthetic oligonucleotide
attttctaaagagctatgtt

SEQ ID NO: 1051 - DNA, 20 bp, Artificial sequence
  Synthetic oligonucleotide
gattttctaaagagctatgt

SEQ ID NO: 1052 - DNA, 20 bp, Artificial sequence
  Synthetic oligonucleotide
ggattttctaaagagctatg

SEQ ID NO: 1053 - DNA, 20 bp, Artificial sequence
  Synthetic oligonucleotide
cggattttctaaagagctat

SEQ ID NO: 1054 - DNA, 20 bp, Artificial sequence
  Synthetic oligonucleotide
acggattttctaaagagcta

SEQ ID NO: 1055 - DNA, 20 bp, Artificial sequence
  Synthetic oligonucleotide
cacggattttctaaagagct

SEQ ID NO: 1056 - DNA, 20 bp, Artificial sequence
  Synthetic oligonucleotide
acacggattttctaaagagc

SEQ ID NO: 1057 - DNA, 20 bp, Artificial sequence
  Synthetic oligonucleotide
cacacggattttctaaagag

SEQ ID NO: 1058 - DNA, 20 bp, Artificial sequence
  Synthetic oligonucleotide
ccacacggattttctaaaga

SEQ ID NO: 1059 - DNA, 20 bp, Artificial sequence
  Synthetic oligonucleotide
tccacacggattttctaaag

SEQ ID NO: 1060 - DNA, 20 bp, Artificial sequence
  Synthetic oligonucleotide
tctaaactggttccacacgg

SEQ ID NO: 1061 - DNA, 20 bp, Artificial sequence
  Synthetic oligonucleotide
ttctaaactggttccacacg

SEQ ID NO: 1062 - DNA, 20 bp, Artificial sequence
  Synthetic oligonucleotide
tttctaaactggttccacac

SEQ ID NO: 1063 - DNA, 20 bp, Artificial sequence
  Synthetic oligonucleotide
atttctaaactggttccaca

SEQ ID NO: 1064 - DNA, 20 bp, Artificial sequence
  Synthetic oligonucleotide
catttctaaactggttccac

SEQ ID NO: 1065 - DNA, 20 bp, Artificial sequence
  Synthetic oligonucleotide
acatttctaaactggttcca

SEQ ID NO: 1066 - DNA, 20 bp, Artificial sequence
  Synthetic oligonucleotide
aacatttctaaactggttcc

SEQ ID NO: 1067 - DNA, 20 bp, Artificial sequence
  Synthetic oligonucleotide
aaacatttctaaactggttc

SEQ ID NO: 1068 - DNA, 20 bp, Artificial sequence
  Synthetic oligonucleotide
aaaacatttctaaactggtt

SEQ ID NO: 1069 - DNA, 20 bp, Artificial sequence
  Synthetic oligonucleotide
aaaaacatttctaaactggt

SEQ ID NO: 1070 - DNA, 20 bp, Artificial sequence
  Synthetic oligonucleotide
taaaaacatttctaaactgg

SEQ ID NO: 1071 - DNA, 20 bp, Artificial sequence
  Synthetic oligonucleotide
gcttaaaaacatttctaaac

SEQ ID NO: 1072 - DNA, 20 bp, Artificial sequence
  Synthetic oligonucleotide
ggcttaaaaacatttctaaa

SEQ ID NO: 1073 - DNA, 20 bp, Artificial sequence
  Synthetic oligonucleotide
gggcttaaaaacatttctaa

SEQ ID NO: 1074 - DNA, 20 bp, Artificial sequence
  Synthetic oligonucleotide
agggcttaaaaacatttcta

SEQ ID NO: 1075 - DNA, 20 bp, Artificial sequence
  Synthetic oligonucleotide
aagggcttaaaaacatttct

SEQ ID NO: 1076 - DNA, 20 bp, Artificial sequence
  Synthetic oligonucleotide
aaagggcttaaaaacatttc

SEQ ID NO: 1077 - DNA, 20 bp, Artificial sequence
  Synthetic oligonucleotide
aaaagggcttaaaaacattt

SEQ ID NO: 1078 - DNA, 20 bp, Artificial sequence
  Synthetic oligonucleotide
gaaaagggcttaaaaacatt

SEQ ID NO: 1079 - DNA, 20 bp, Artificial sequence
  Synthetic oligonucleotide
tgaaaagggcttaaaaacat

SEQ ID NO: 1080 - DNA, 20 bp, Artificial sequence
  Synthetic oligonucleotide
ctgaaaagggcttaaaaaca

SEQ ID NO: 1081 - DNA, 20 bp, Artificial sequence
  Synthetic oligonucleotide
tctgaaaagggcttaaaaac

SEQ ID NO: 1082 - DNA, 20 bp, Artificial sequence
  Synthetic oligonucleotide
gtctgaaaagggcttaaaaa

SEQ ID NO: 1083 - DNA, 20 bp, Artificial sequence
  Synthetic oligonucleotide
tgtctgaaaagggcttaaaa

SEQ ID NO: 1084 - DNA, 20 bp, Artificial sequence
  Synthetic oligonucleotide
gtgtctgaaaagggcttaaa

SEQ ID NO: 1085 - DNA, 20 bp, Artificial sequence
  Synthetic oligonucleotide
ggtgtctgaaaagggcttaa

SEQ ID NO: 1086 - DNA, 20 bp, Artificial sequence
  Synthetic oligonucleotide
tggtgtctgaaaagggctta

SEQ ID NO: 1087 - DNA, 20 bp, Artificial sequence
  Synthetic oligonucleotide
atggtgtctgaaaagggctt

SEQ ID NO: 1088 - DNA, 20 bp, Artificial sequence
  Synthetic oligonucleotide
catggtgtctgaaaagggct

SEQ ID NO: 1089 - DNA, 20 bp, Artificial sequence
  Synthetic oligonucleotide
acatggtgtctgaaaagggc

SEQ ID NO: 1090 - DNA, 20 bp, Artificial sequence
  Synthetic oligonucleotide
tcctcaaagtgacatggtgt

SEQ ID NO: 1091 - DNA, 20 bp, Artificial sequence
  Synthetic oligonucleotide
ctcctcaaagtgacatggtg

SEQ ID NO: 1092 - DNA, 20 bp, Artificial sequence
  Synthetic oligonucleotide
tctcctcaaagtgacatggt

SEQ ID NO: 1093 - DNA, 20 bp, Artificial sequence
  Synthetic oligonucleotide
ctctcctcaaagtgacatgg

SEQ ID NO: 1094 - DNA, 20 bp, Artificial sequence
  Synthetic oligonucleotide
actctcctcaaagtgacatg

SEQ ID NO: 1095 - DNA, 20 bp, Artificial sequence
  Synthetic oligonucleotide
ctgcccactctcctcaaagt

SEQ ID NO: 1096 - DNA, 20 bp, Artificial sequence
  Synthetic oligonucleotide
tcctgcccactctcctcaaa

SEQ ID NO: 1097 - DNA, 20 bp, Artificial sequence
  Synthetic oligonucleotide
atcctgcccactctcctcaa

SEQ ID NO: 1098 - DNA, 20 bp, Artificial sequence
  Synthetic oligonucleotide
tagatcctgcccactctcct

SEQ ID NO: 1099 - DNA, 20 bp, Artificial sequence
  Synthetic oligonucleotide
tctagatcctgcccactctc

SEQ ID NO: 1100 - DNA, 20 bp, Artificial sequence
  Synthetic oligonucleotide
ttctagatcctgcccactct

SEQ ID NO: 1101 - DNA, 20 bp, Artificial sequence
  Synthetic oligonucleotide
tttctagatcctgcccactc

SEQ ID NO: 1102 - DNA, 20 bp, Artificial sequence
  Synthetic oligonucleotide
atttctagatcctgcccact

SEQ ID NO: 1103 - DNA, 20 bp, Artificial sequence
  Synthetic oligonucleotide
tatttctagatcctgcccac

SEQ ID NO: 1104 - DNA, 20 bp, Artificial sequence
  Synthetic oligonucleotide
atatttctagatcctgccca

SEQ ID NO: 1105 - DNA, 20 bp, Artificial sequence
  Synthetic oligonucleotide
catatttctagatcctgccc

SEQ ID NO: 1106 - DNA, 20 bp, Artificial sequence
  Synthetic oligonucleotide
ccatatttctagatcctgcc

SEQ ID NO: 1107 - DNA, 20 bp, Artificial sequence
  Synthetic oligonucleotide
tccatatttctagatcctgc

SEQ ID NO: 1108 - DNA, 20 bp, Artificial sequence
  Synthetic oligonucleotide
ttccatatttctagatcctg

SEQ ID NO: 1109 - DNA, 20 bp, Artificial sequence
  Synthetic oligonucleotide
tttccatatttctagatcct

SEQ ID NO: 1110 - DNA, 20 bp, Artificial sequence
  Synthetic oligonucleotide
ctttccatatttctagatcc

SEQ ID NO: 1111 - DNA, 20 bp, Artificial sequence
  Synthetic oligonucleotide
tctttccatatttctagatc

SEQ ID NO: 1112 - DNA, 20 bp, Artificial sequence
  Synthetic oligonucleotide
ttctttccatatttctagat

SEQ ID NO: 1113 - DNA, 20 bp, Artificial sequence
  Synthetic oligonucleotide
tttctttccatatttctaga

SEQ ID NO: 1114 - DNA, 20 bp, Artificial sequence
  Synthetic oligonucleotide
ctttctttccatatttctag

SEQ ID NO: 1115 - DNA, 20 bp, Artificial sequence
  Synthetic oligonucleotide
actttctttccatatttcta

SEQ ID NO: 1116 - DNA, 20 bp, Artificial sequence
  Synthetic oligonucleotide
tactttctttccatatttct

SEQ ID NO: 1117 - DNA, 20 bp, Artificial sequence
  Synthetic oligonucleotide
gtactttctttccatatttc

SEQ ID NO: 1118 - DNA, 20 bp, Artificial sequence
  Synthetic oligonucleotide
agtactttctttccatattt

SEQ ID NO: 1119 - DNA, 20 bp, Artificial sequence
  Synthetic oligonucleotide
tagtactttctttccatatt

SEQ ID NO: 1120 - DNA, 20 bp, Artificial sequence
  Synthetic oligonucleotide
gtagtactttctttccatat

SEQ ID NO: 1121 - DNA, 20 bp, Artificial sequence
  Synthetic oligonucleotide
agtagtactttctttccata

SEQ ID NO: 1122 - DNA, 20 bp, Artificial sequence
  Synthetic oligonucleotide
cagtagtactttctttccat

SEQ ID NO: 1123 - DNA, 20 bp, Artificial sequence
  Synthetic oligonucleotide
acagtagtactttctttcca

SEQ ID NO: 1124 - DNA, 20 bp, Artificial sequence
  Synthetic oligonucleotide
aacagtagtactttctttcc

SEQ ID NO: 1125 - DNA, 20 bp, Artificial sequence
  Synthetic oligonucleotide
taacagtagtactttctttc

SEQ ID NO: 1126 - DNA, 20 bp, Artificial sequence
  Synthetic oligonucleotide
ttaacagtagtactttcttt

SEQ ID NO: 1127 - DNA, 20 bp, Artificial sequence
  Synthetic oligonucleotide
attaacagtagtactttctt

SEQ ID NO: 1128 - DNA, 20 bp, Artificial sequence
  Synthetic oligonucleotide
cattaacagtagtactttct

SEQ ID NO: 1129 - DNA, 20 bp, Artificial sequence
  Synthetic oligonucleotide
ccattaacagtagtactttc

SEQ ID NO: 1130 - DNA, 20 bp, Artificial sequence
  Synthetic oligonucleotide
gccattaacagtagtacttt

SEQ ID NO: 1131 - DNA, 20 bp, Artificial sequence
  Synthetic oligonucleotide
tgccattaacagtagtactt

SEQ ID NO: 1132 - DNA, 20 bp, Artificial sequence
  Synthetic oligonucleotide
atgccattaacagtagtact

SEQ ID NO: 1133 - DNA, 20 bp, Artificial sequence
  Synthetic oligonucleotide
catgccattaacagtagtac

SEQ ID NO: 1134 - DNA, 20 bp, Artificial sequence
  Synthetic oligonucleotide
ccatgccattaacagtagta

SEQ ID NO: 1135 - DNA, 20 bp, Artificial sequence
  Synthetic oligonucleotide
gccatgccattaacagtagt

SEQ ID NO: 1136 - DNA, 20 bp, Artificial sequence
  Synthetic oligonucleotide
agccatgccattaacagtag

SEQ ID NO: 1137 - DNA, 20 bp, Artificial sequence
  Synthetic oligonucleotide
cagccatgccattaacagta

SEQ ID NO: 1138 - DNA, 20 bp, Artificial sequence
  Synthetic oligonucleotide
tcaagatgttggcagccatg

SEQ ID NO: 1139 - DNA, 20 bp, Artificial sequence
  Synthetic oligonucleotide
ttcaagatgttggcagccat

SEQ ID NO: 1140 - DNA, 20 bp, Artificial sequence
  Synthetic oligonucleotide
tttcaagatgttggcagcca

SEQ ID NO: 1141 - DNA, 20 bp, Artificial sequence
  Synthetic oligonucleotide
ttttcaagatgttggcagcc

SEQ ID NO: 1142 - DNA, 20 bp, Artificial sequence
  Synthetic oligonucleotide
tttttcaagatgttggcagc

SEQ ID NO: 1143 - DNA, 20 bp, Artificial sequence
  Synthetic oligonucleotide
atttttcaagatgttggcag

SEQ ID NO: 1144 - DNA, 20 bp, Artificial sequence
  Synthetic oligonucleotide
tatttttcaagatgttggca

SEQ ID NO: 1145 - DNA, 20 bp, Artificial sequence
  Synthetic oligonucleotide
ttatttttcaagatgttggc

SEQ ID NO: 1146 - DNA, 20 bp, Artificial sequence
  Synthetic oligonucleotide
attatttttcaagatgttgg

SEQ ID NO: 1147 - DNA, 20 bp, Artificial sequence
  Synthetic oligonucleotide
gttgattctgaattctatta

SEQ ID NO: 1148 - DNA, 20 bp, Artificial sequence
  Synthetic oligonucleotide
ggttgattctgaattctatt

SEQ ID NO: 1149 - DNA, 20 bp, Artificial sequence
  Synthetic oligonucleotide
tggttgattctgaattctat

SEQ ID NO: 1150 - DNA, 20 bp, Artificial sequence
  Synthetic oligonucleotide
ttggttgattctgaattcta

SEQ ID NO: 1151 - DNA, 20 bp, Artificial sequence
  Synthetic oligonucleotide
tttggttgattctgaattct

SEQ ID NO: 1152 - DNA, 20 bp, Artificial sequence
  Synthetic oligonucleotide
ctttggttgattctgaattc

SEQ ID NO: 1153 - DNA, 20 bp, Artificial sequence
  Synthetic oligonucleotide
tctttggttgattctgaatt

SEQ ID NO: 1154 - DNA, 20 bp, Artificial sequence
  Synthetic oligonucleotide
ctctttggttgattctgaat

SEQ ID NO: 1155 - DNA, 20 bp, Artificial sequence
  Synthetic oligonucleotide
tctctttggttgattctgaa

SEQ ID NO: 1156 - DNA, 20 bp, Artificial sequence
  Synthetic oligonucleotide
atctctttggttgattctga

SEQ ID NO: 1157 - DNA, 20 bp, Artificial sequence
  Synthetic oligonucleotide
aatctctttggttgattctg

SEQ ID NO: 1158 - DNA, 20 bp, Artificial sequence
  Synthetic oligonucleotide
aaatctctttggttgattct

SEQ ID NO: 1159 - DNA, 20 bp, Artificial sequence
  Synthetic oligonucleotide
taaatctctttggttgattc

SEQ ID NO: 1160 - DNA, 20 bp, Artificial sequence
  Synthetic oligonucleotide
ttaaatctctttggttgatt

SEQ ID NO: 1161 - DNA, 20 bp, Artificial sequence
  Synthetic oligonucleotide
tttaaatctctttggttgat

SEQ ID NO: 1162 - DNA, 20 bp, Artificial sequence
  Synthetic oligonucleotide
ctttaaatctctttggttga

SEQ ID NO: 1163 - DNA, 20 bp, Artificial sequence
  Synthetic oligonucleotide
tctttaaatctctttggttg

SEQ ID NO: 1164 - DNA, 20 bp, Artificial sequence
  Synthetic oligonucleotide
atctttaaatctctttggtt

SEQ ID NO: 1165 - DNA, 20 bp, Artificial sequence
  Synthetic oligonucleotide
catctttaaatctctttggt

SEQ ID NO: 1166 - DNA, 20 bp, Artificial sequence
  Synthetic oligonucleotide
gcatctttaaatctctttgg

SEQ ID NO: 1167 - DNA, 20 bp, Artificial sequence
  Synthetic oligonucleotide
agcatctttaaatctctttg

SEQ ID NO: 1168 - DNA, 20 bp, Artificial sequence
  Synthetic oligonucleotide
tagcatctttaaatctcttt

SEQ ID NO: 1169 - DNA, 20 bp, Artificial sequence
  Synthetic oligonucleotide
gtagcatctttaaatctctt

SEQ ID NO: 1170 - DNA, 20 bp, Artificial sequence
  Synthetic oligonucleotide
agtagcatctttaaatctct

SEQ ID NO: 1171 - DNA, 20 bp, Artificial sequence
  Synthetic oligonucleotide
cagtagcatctttaaatctc

SEQ ID NO: 1172 - DNA, 20 bp, Artificial sequence
  Synthetic oligonucleotide
tcagtagcatctttaaatct

SEQ ID NO: 1173 - DNA, 20 bp, Artificial sequence
  Synthetic oligonucleotide
ttcagtagcatctttaaatc

SEQ ID NO: 1174 - DNA, 20 bp, Artificial sequence
  Synthetic oligonucleotide
cttcagtagcatctttaaat

SEQ ID NO: 1175 - DNA, 20 bp, Artificial sequence
  Synthetic oligonucleotide
acttcagtagcatctttaaa

SEQ ID NO: 1176 - DNA, 20 bp, Artificial sequence
  Synthetic oligonucleotide
cacttcagtagcatctttaa

SEQ ID NO: 1177 - DNA, 20 bp, Artificial sequence
  Synthetic oligonucleotide
ccacttcagtagcatcttta

SEQ ID NO: 1178 - DNA, 20 bp, Artificial sequence
  Synthetic oligonucleotide
cccacttcagtagcatcttt

SEQ ID NO: 1179 - DNA, 20 bp, Artificial sequence
  Synthetic oligonucleotide
tcccacttcagtagcatctt

SEQ ID NO: 1180 - DNA, 20 bp, Artificial sequence
  Synthetic oligonucleotide
atcccacttcagtagcatct

SEQ ID NO: 1181 - DNA, 20 bp, Artificial sequence
  Synthetic oligonucleotide
catcccacttcagtagcatc

SEQ ID NO: 1182 - DNA, 20 bp, Artificial sequence
  Synthetic oligonucleotide
gcatcccacttcagtagcat

SEQ ID NO: 1183 - DNA, 20 bp, Artificial sequence
  Synthetic oligonucleotide
ggcatcccacttcagtagca

SEQ ID NO: 1184 - DNA, 20 bp, Artificial sequence
  Synthetic oligonucleotide
tggcatcccacttcagtagc

SEQ ID NO: 1185 - DNA, 20 bp, Artificial sequence
  Synthetic oligonucleotide
ctggcatcccacttcagtag

SEQ ID NO: 1186 - DNA, 20 bp, Artificial sequence
  Synthetic oligonucleotide
gctggcatcccacttcagta

SEQ ID NO: 1187 - DNA, 20 bp, Artificial sequence
  Synthetic oligonucleotide
cataatgttgttgcaaaagg

SEQ ID NO: 1188 - DNA, 20 bp, Artificial sequence
  Synthetic oligonucleotide
ccataatgttgttgcaaaag

SEQ ID NO: 1189 - DNA, 20 bp, Artificial sequence
  Synthetic oligonucleotide
cccataatgttgttgcaaaa

SEQ ID NO: 1190 - DNA, 20 bp, Artificial sequence
  Synthetic oligonucleotide
ccccataatgttgttgcaaa

SEQ ID NO: 1191 - DNA, 20 bp, Artificial sequence
  Synthetic oligonucleotide
tccccataatgttgttgcaa

SEQ ID NO: 1192 - DNA, 20 bp, Artificial sequence
  Synthetic oligonucleotide
ctccccataatgttgttgca

SEQ ID NO: 1193 - DNA, 20 bp, Artificial sequence
  Synthetic oligonucleotide
actccccataatgttgttgc

SEQ ID NO: 1194 - DNA, 20 bp, Artificial sequence
  Synthetic oligonucleotide
tactccccataatgttgttg

SEQ ID NO: 1195 - DNA, 20 bp, Artificial sequence
  Synthetic oligonucleotide
gtactccccataatgttgtt

SEQ ID NO: 1196 - DNA, 20 bp, Artificial sequence
  Synthetic oligonucleotide
tgtactccccataatgttgt

SEQ ID NO: 1197 - DNA, 20 bp, Artificial sequence
  Synthetic oligonucleotide
atgtactccccataatgttg

SEQ ID NO: 1198 - DNA, 20 bp, Artificial sequence
  Synthetic oligonucleotide
tatgtactccccataatgtt

SEQ ID NO: 1199 - DNA, 20 bp, Artificial sequence
  Synthetic oligonucleotide
ctatgtactccccataatgt

SEQ ID NO: 1200 - DNA, 20 bp, Artificial sequence
  Synthetic oligonucleotide
actatgtactccccataatg

SEQ ID NO: 1201 - DNA, 20 bp, Artificial sequence
  Synthetic oligonucleotide
cactatgtactccccataat

SEQ ID NO: 1202 - DNA, 20 bp, Artificial sequence
  Synthetic oligonucleotide
gcactatgtactccccataa

SEQ ID NO: 1203 - DNA, 20 bp, Artificial sequence
  Synthetic oligonucleotide
agcactatgtactccccata

SEQ ID NO: 1204 - DNA, 20 bp, Artificial sequence
  Synthetic oligonucleotide
gagcactatgtactccccat

SEQ ID NO: 1205 - DNA, 20 bp, Artificial sequence
  Synthetic oligonucleotide
tgagcactatgtactcccca

SEQ ID NO: 1206 - DNA, 20 bp, Artificial sequence
  Synthetic oligonucleotide
ctgagcactatgtactcccc

SEQ ID NO: 1207 - DNA, 20 bp, Artificial sequence
  Synthetic oligonucleotide
tctgagcactatgtactccc

SEQ ID NO: 1208 - DNA, 20 bp, Artificial sequence
  Synthetic oligonucleotide
gtctgagcactatgtactcc

SEQ ID NO: 1209 - DNA, 20 bp, Artificial sequence
  Synthetic oligonucleotide
tgtctgagcactatgtactc

SEQ ID NO: 1210 - DNA, 20 bp, Artificial sequence
  Synthetic oligonucleotide
ctgtctgagcactatgtact

SEQ ID NO: 1211 - DNA, 20 bp, Artificial sequence
  Synthetic oligonucleotide
tctgtctgagcactatgtac

SEQ ID NO: 1212 - DNA, 20 bp, Artificial sequence
  Synthetic oligonucleotide
ctctgtctgagcactatgta

SEQ ID NO: 1213 - DNA, 20 bp, Artificial sequence
  Synthetic oligonucleotide
ttttctctttctctgtctga

SEQ ID NO: 1214 - DNA, 20 bp, Artificial sequence
  Synthetic oligonucleotide
tttttctctttctctgtctg

SEQ ID NO: 1215 - DNA, 20 bp, Artificial sequence
  Synthetic oligonucleotide
acaattgctagattcttttt

SEQ ID NO: 1216 - DNA, 20 bp, Artificial sequence
  Synthetic oligonucleotide
cacaattgctagattctttt

SEQ ID NO: 1217 - DNA, 20 bp, Artificial sequence
  Synthetic oligonucleotide
ccacaattgctagattcttt

SEQ ID NO: 1218 - DNA, 20 bp, Artificial sequence
  Synthetic oligonucleotide
tccacaattgctagattctt

SEQ ID NO: 1219 - DNA, 20 bp, Artificial sequence
  Synthetic oligonucleotide
ttccacaattgctagattct

SEQ ID NO: 1220 - DNA, 20 bp, Artificial sequence
  Synthetic oligonucleotide
cttccacaattgctagattc

SEQ ID NO: 1221 - DNA, 20 bp, Artificial sequence
  Synthetic oligonucleotide
tcttccacaattgctagatt

SEQ ID NO: 1222 - DNA, 20 bp, Artificial sequence
  Synthetic oligonucleotide
ttcttccacaattgctagat

SEQ ID NO: 1223 - DNA, 20 bp, Artificial sequence
  Synthetic oligonucleotide
cttcttccacaattgctaga

SEQ ID NO: 1224 - DNA, 20 bp, Artificial sequence
  Synthetic oligonucleotide
tcttcttccacaattgctag

SEQ ID NO: 1225 - DNA, 20 bp, Artificial sequence
  Synthetic oligonucleotide
ttcttcttccacaattgcta

SEQ ID NO: 1226 - DNA, 20 bp, Artificial sequence
  Synthetic oligonucleotide
tttcttcttccacaattgct

SEQ ID NO: 1227 - DNA, 20 bp, Artificial sequence
  Synthetic oligonucleotide
atttcttcttccacaattgc

SEQ ID NO: 1228 - DNA, 20 bp, Artificial sequence
  Synthetic oligonucleotide
catttcttcttccacaattg

SEQ ID NO: 1229 - DNA, 20 bp, Artificial sequence
  Synthetic oligonucleotide
acatttcttcttccacaatt

SEQ ID NO: 1230 - DNA, 20 bp, Artificial sequence
  Synthetic oligonucleotide
aacatttcttcttccacaat

SEQ ID NO: 1231 - DNA, 20 bp, Artificial sequence
  Synthetic oligonucleotide
aaacatttcttcttccacaa

SEQ ID NO: 1232 - DNA, 20 bp, Artificial sequence
  Synthetic oligonucleotide
aaaacatttcttcttccaca

SEQ ID NO: 1233 - DNA, 20 bp, Artificial sequence
  Synthetic oligonucleotide
aaaaacatttcttcttccac

SEQ ID NO: 1234 - DNA, 20 bp, Artificial sequence
  Synthetic oligonucleotide
taaaaacatttcttcttcca

SEQ ID NO: 1235 - DNA, 20 bp, Artificial sequence
  Synthetic oligonucleotide
ctaaaaacatttcttcttcc

SEQ ID NO: 1236 - DNA, 20 bp, Artificial sequence
  Synthetic oligonucleotide
actaaaaacatttcttcttc

SEQ ID NO: 1237 - DNA, 20 bp, Artificial sequence
  Synthetic oligonucleotide
ccataactaaaaacatttct

SEQ ID NO: 1238 - DNA, 20 bp, Artificial sequence
  Synthetic oligonucleotide
cccataactaaaaacatttc

SEQ ID NO: 1239 - DNA, 20 bp, Artificial sequence
  Synthetic oligonucleotide
gcccataactaaaaacattt

SEQ ID NO: 1240 - DNA, 20 bp, Artificial sequence
  Synthetic oligonucleotide
cgcccataactaaaaacatt

SEQ ID NO: 1241 - DNA, 20 bp, Artificial sequence
  Synthetic oligonucleotide
tcgcccataactaaaaacat

SEQ ID NO: 1242 - DNA, 20 bp, Artificial sequence
  Synthetic oligonucleotide
ctcgcccataactaaaaaca

SEQ ID NO: 1243 - DNA, 20 bp, Artificial sequence
  Synthetic oligonucleotide
actcgcccataactaaaaac

SEQ ID NO: 1244 - DNA, 20 bp, Artificial sequence
  Synthetic oligonucleotide
aactcgcccataactaaaaa

SEQ ID NO: 1245 - DNA, 20 bp, Artificial sequence
  Synthetic oligonucleotide
taactcgcccataactaaaa

SEQ ID NO: 1246 - DNA, 20 bp, Artificial sequence
  Synthetic oligonucleotide
ttaactcgcccataactaaa

SEQ ID NO: 1247 - DNA, 20 bp, Artificial sequence
  Synthetic oligonucleotide
tttaactcgcccataactaa

SEQ ID NO: 1248 - DNA, 20 bp, Artificial sequence
  Synthetic oligonucleotide
atttaactcgcccataacta

SEQ ID NO: 1249 - DNA, 20 bp, Artificial sequence
  Synthetic oligonucleotide
aatttaactcgcccataact

SEQ ID NO: 1250 - DNA, 20 bp, Artificial sequence
  Synthetic oligonucleotide
taatttaactcgcccataac

SEQ ID NO: 1251 - DNA, 20 bp, Artificial sequence
  Synthetic oligonucleotide
ataatttaactcgcccataa

SEQ ID NO: 1252 - DNA, 20 bp, Artificial sequence
  Synthetic oligonucleotide
cataatttaactcgcccata

SEQ ID NO: 1253 - DNA, 20 bp, Artificial sequence
  Synthetic oligonucleotide
acataatttaactcgcccat

SEQ ID NO: 1254 - DNA, 20 bp, Artificial sequence
  Synthetic oligonucleotide
aacataatttaactcgccca

SEQ ID NO: 1255 - DNA, 20 bp, Artificial sequence
  Synthetic oligonucleotide
gaacataatttaactcgccc

SEQ ID NO: 1256 - DNA, 20 bp, Artificial sequence
  Synthetic oligonucleotide
ggaacataatttaactcgcc

SEQ ID NO: 1257 - DNA, 20 bp, Artificial sequence
  Synthetic oligonucleotide
tggaacataatttaactcgc

SEQ ID NO: 1258 - DNA, 20 bp, Artificial sequence
  Synthetic oligonucleotide
agttataaagccagtggaac

SEQ ID NO: 1259 - DNA, 20 bp, Artificial sequence
  Synthetic oligonucleotide
gagttataaagccagtggaa

SEQ ID NO: 1260 - DNA, 20 bp, Artificial sequence
  Synthetic oligonucleotide
tgagttataaagccagtgga

SEQ ID NO: 1261 - DNA, 20 bp, Artificial sequence
  Synthetic oligonucleotide
atgagttataaagccagtgg

SEQ ID NO: 1262 - DNA, 20 bp, Artificial sequence
  Synthetic oligonucleotide
catgagttataaagccagtg

SEQ ID NO: 1263 - DNA, 20 bp, Artificial sequence
  Synthetic oligonucleotide
acatgagttataaagccagt

SEQ ID NO: 1264 - DNA, 20 bp, Artificial sequence
  Synthetic oligonucleotide
tacatgagttataaagccag

SEQ ID NO: 1265 - DNA, 20 bp, Artificial sequence
  Synthetic oligonucleotide
ctacatgagttataaagcca

SEQ ID NO: 1266 - DNA, 20 bp, Artificial sequence
  Synthetic oligonucleotide
actacatgagttataaagcc

SEQ ID NO: 1267 - DNA, 20 bp, Artificial sequence
  Synthetic oligonucleotide
ttcattttgtactacatgag

SEQ ID NO: 1268 - DNA, 20 bp, Artificial sequence
  Synthetic oligonucleotide
tttcattttgtactacatga

SEQ ID NO: 1269 - DNA, 20 bp, Artificial sequence
  Synthetic oligonucleotide
ttttcattttgtactacatg

SEQ ID NO: 1270 - DNA, 20 bp, Artificial sequence
  Synthetic oligonucleotide
gtttcagttgatttagtttt

SEQ ID NO: 1271 - DNA, 20 bp, Artificial sequence
  Synthetic oligonucleotide
tgtttcagttgatttagttt

SEQ ID NO: 1272 - DNA, 20 bp, Artificial sequence
  Synthetic oligonucleotide
ctgtttcagttgatttagtt

SEQ ID NO: 1273 - DNA, 20 bp, Artificial sequence
  Synthetic oligonucleotide
tctgtttcagttgatttagt

SEQ ID NO: 1274 - DNA, 20 bp, Artificial sequence
  Synthetic oligonucleotide
ttctgtttcagttgatttag

SEQ ID NO: 1275 - DNA, 20 bp, Artificial sequence
  Synthetic oligonucleotide
gttctgtttcagttgattta

SEQ ID NO: 1276 - DNA, 20 bp, Artificial sequence
  Synthetic oligonucleotide
tgttctgtttcagttgattt

SEQ ID NO: 1277 - DNA, 20 bp, Artificial sequence
  Synthetic oligonucleotide
atgttctgtttcagttgatt

SEQ ID NO: 1278 - DNA, 20 bp, Artificial sequence
  Synthetic oligonucleotide
aatgttctgtttcagttgat

SEQ ID NO: 1279 - DNA, 20 bp, Artificial sequence
  Synthetic oligonucleotide
gaatgttctgtttcagttga

SEQ ID NO: 1280 - DNA, 20 bp, Artificial sequence
  Synthetic oligonucleotide
tgaatgttctgtttcagttg

SEQ ID NO: 1281 - DNA, 20 bp, Artificial sequence
  Synthetic oligonucleotide
atgaatgttctgtttcagtt

SEQ ID NO: 1282 - DNA, 20 bp, Artificial sequence
  Synthetic oligonucleotide
aatgaatgttctgtttcagt

SEQ ID NO: 1283 - DNA, 20 bp, Artificial sequence
  Synthetic oligonucleotide
aaatgaatgttctgtttcag

SEQ ID NO: 1284 - DNA, 20 bp, Artificial sequence
  Synthetic oligonucleotide
taaatgaatgttctgtttca

SEQ ID NO: 1285 - DNA, 20 bp, Artificial sequence
  Synthetic oligonucleotide
ttaaatgaatgttctgtttc

SEQ ID NO: 1286 - DNA, 20 bp, Artificial sequence
  Synthetic oligonucleotide
caggtctaacataattttta

SEQ ID NO: 1287 - DNA, 20 bp, Artificial sequence
  Synthetic oligonucleotide
ccaggtctaacataattttt

SEQ ID NO: 1288 - DNA, 20 bp, Artificial sequence
  Synthetic oligonucleotide
accaggtctaacataatttt

SEQ ID NO: 1289 - DNA, 20 bp, Artificial sequence
  Synthetic oligonucleotide
gaccaggtctaacataattt

SEQ ID NO: 1290 - DNA, 20 bp, Artificial sequence
  Synthetic oligonucleotide
ggaccaggtctaacataatt

SEQ ID NO: 1291 - DNA, 20 bp, Artificial sequence
  Synthetic oligonucleotide
gggaccaggtctaacataat

SEQ ID NO: 1292 - DNA, 20 bp, Artificial sequence
  Synthetic oligonucleotide
tgggaccaggtctaacataa

SEQ ID NO: 1293 - DNA, 20 bp, Artificial sequence
  Synthetic oligonucleotide
gtgggaccaggtctaacata

SEQ ID NO: 1294 - DNA, 20 bp, Artificial sequence
  Synthetic oligonucleotide
tgtgggaccaggtctaacat

SEQ ID NO: 1295 - DNA, 20 bp, Artificial sequence
  Synthetic oligonucleotide
gtgtgggaccaggtctaaca

SEQ ID NO: 1296 - DNA, 20 bp, Artificial sequence
  Synthetic oligonucleotide
acgtgtgggaccaggtctaa

SEQ ID NO: 1297 - DNA, 20 bp, Artificial sequence
  Synthetic oligonucleotide
tttcttgggcacgtgtggga

SEQ ID NO: 1298 - DNA, 20 bp, Artificial sequence
  Synthetic oligonucleotide
tgtttcttgggcacgtgtgg

SEQ ID NO: 1299 - DNA, 20 bp, Artificial sequence
  Synthetic oligonucleotide
atgtttcttgggcacgtgtg

SEQ ID NO: 1300 - DNA, 20 bp, Artificial sequence
  Synthetic oligonucleotide
aatgtttcttgggcacgtgt

SEQ ID NO: 1301 - DNA, 20 bp, Artificial sequence
  Synthetic oligonucleotide
aaatgtttcttgggcacgtg

SEQ ID NO: 1302 - DNA, 20 bp, Artificial sequence
  Synthetic oligonucleotide
caaatgtttcttgggcacgt

SEQ ID NO: 1303 - DNA, 20 bp, Artificial sequence
  Synthetic oligonucleotide
ctatttccaaatgtttcttg

SEQ ID NO: 1304 - DNA, 20 bp, Artificial sequence
  Synthetic oligonucleotide
tctatttccaaatgtttctt

SEQ ID NO: 1305 - DNA, 20 bp, Artificial sequence
  Synthetic oligonucleotide
ttctatttccaaatgtttct

SEQ ID NO: 1306 - DNA, 20 bp, Artificial sequence
  Synthetic oligonucleotide
gttctatttccaaatgtttc

SEQ ID NO: 1307 - DNA, 20 bp, Artificial sequence
  Synthetic oligonucleotide
tgttctatttccaaatgttt

SEQ ID NO: 1308 - DNA, 20 bp, Artificial sequence
  Synthetic oligonucleotide
gtgttctatttccaaatgtt

SEQ ID NO: 1309 - DNA, 20 bp, Artificial sequence
  Synthetic oligonucleotide
cgtgttctatttccaaatgt

SEQ ID NO: 1310 - DNA, 20 bp, Artificial sequence
  Synthetic oligonucleotide
acgtgttctatttccaaatg

SEQ ID NO: 1311 - DNA, 20 bp, Artificial sequence
  Synthetic oligonucleotide
gacgtgttctatttccaaat

SEQ ID NO: 1312 - DNA, 20 bp, Artificial sequence
  Synthetic oligonucleotide
tgacgtgttctatttccaaa

SEQ ID NO: 1313 - DNA, 20 bp, Artificial sequence
  Synthetic oligonucleotide
atgacgtgttctatttccaa

SEQ ID NO: 1314 - DNA, 20 bp, Artificial sequence
  Synthetic oligonucleotide
aatgacgtgttctatttcca

SEQ ID NO: 1315 - DNA, 20 bp, Artificial sequence
  Synthetic oligonucleotide
gaatgacgtgttctatttcc

SEQ ID NO: 1316 - DNA, 20 bp, Artificial sequence
  Synthetic oligonucleotide
tgaatgacgtgttctatttc

SEQ ID NO: 1317 - DNA, 20 bp, Artificial sequence
  Synthetic oligonucleotide
ctgaatgacgtgttctattt

SEQ ID NO: 1318 - DNA, 20 bp, Artificial sequence
  Synthetic oligonucleotide
actgaatgacgtgttctatt

SEQ ID NO: 1319 - DNA, 20 bp, Artificial sequence
  Synthetic oligonucleotide
aactgaatgacgtgttctat

SEQ ID NO: 1320 - DNA, 20 bp, Artificial sequence
  Synthetic oligonucleotide
caactgaatgacgtgttcta

SEQ ID NO: 1321 - DNA, 20 bp, Artificial sequence
  Synthetic oligonucleotide
tcaactgaatgacgtgttct

SEQ ID NO: 1322 - DNA, 20 bp, Artificial sequence
  Synthetic oligonucleotide
ttcaactgaatgacgtgttc

SEQ ID NO: 1323 - DNA, 20 bp, Artificial sequence
  Synthetic oligonucleotide
tttcaactgaatgacgtgtt

SEQ ID NO: 1324 - DNA, 20 bp, Artificial sequence
  Synthetic oligonucleotide
gtttcaactgaatgacgtgt

SEQ ID NO: 1325 - DNA, 20 bp, Artificial sequence
  Synthetic oligonucleotide
agtttcaactgaatgacgtg

SEQ ID NO: 1326 - DNA, 20 bp, Artificial sequence
  Synthetic oligonucleotide
ttgatgtctggagtttcaac

SEQ ID NO: 1327 - DNA, 20 bp, Artificial sequence
  Synthetic oligonucleotide
tttgatgtctggagtttcaa

SEQ ID NO: 1328 - DNA, 20 bp, Artificial sequence
  Synthetic oligonucleotide
ctttgatgtctggagtttca

SEQ ID NO: 1329 - DNA, 20 bp, Artificial sequence
  Synthetic oligonucleotide
tctttgatgtctggagtttc

SEQ ID NO: 1330 - DNA, 20 bp, Artificial sequence
  Synthetic oligonucleotide
atctttgatgtctggagttt

SEQ ID NO: 1331 - DNA, 20 bp, Artificial sequence
  Synthetic oligonucleotide
aatctttgatgtctggagtt

SEQ ID NO: 1332 - DNA, 20 bp, Artificial sequence
  Synthetic oligonucleotide
aaatctttgatgtctggagt

SEQ ID NO: 1333 - DNA, 20 bp, Artificial sequence
  Synthetic oligonucleotide
taaatctttgatgtctggag

SEQ ID NO: 1334 - DNA, 20 bp, Artificial sequence
  Synthetic oligonucleotide
ctaaatctttgatgtctgga

SEQ ID NO: 1335 - DNA, 20 bp, Artificial sequence
  Synthetic oligonucleotide
gctaaatctttgatgtctgg

SEQ ID NO: 1336 - DNA, 20 bp, Artificial sequence
  Synthetic oligonucleotide
ggctaaatctttgatgtctg

SEQ ID NO: 1337 - DNA, 20 bp, Artificial sequence
  Synthetic oligonucleotide
tggctaaatctttgatgtct

SEQ ID NO: 1338 - DNA, 20 bp, Artificial sequence
  Synthetic oligonucleotide
ctggctaaatctttgatgtc

SEQ ID NO: 1339 - DNA, 20 bp, Artificial sequence
  Synthetic oligonucleotide
gctggctaaatctttgatgt

SEQ ID NO: 1340 - DNA, 20 bp, Artificial sequence
  Synthetic oligonucleotide
tgctggctaaatctttgatg

SEQ ID NO: 1341 - DNA, 20 bp, Artificial sequence
  Synthetic oligonucleotide
gtgctggctaaatctttgat

SEQ ID NO: 1342 - DNA, 20 bp, Artificial sequence
  Synthetic oligonucleotide
agtgctggctaaatctttga

SEQ ID NO: 1343 - DNA, 20 bp, Artificial sequence
  Synthetic oligonucleotide
aagtgctggctaaatctttg

SEQ ID NO: 1344 - DNA, 20 bp, Artificial sequence
  Synthetic oligonucleotide
aaagtgctggctaaatcttt

SEQ ID NO: 1345 - DNA, 20 bp, Artificial sequence
  Synthetic oligonucleotide
taaagtgctggctaaatctt

SEQ ID NO: 1346 - DNA, 20 bp, Artificial sequence
  Synthetic oligonucleotide
ttaaagtgctggctaaatct

SEQ ID NO: 1347 - DNA, 20 bp, Artificial sequence
  Synthetic oligonucleotide
cttaaagtgctggctaaatc

SEQ ID NO: 1348 - DNA, 20 bp, Artificial sequence
  Synthetic oligonucleotide
acttaaagtgctggctaaat

SEQ ID NO: 1349 - DNA, 20 bp, Artificial sequence
  Synthetic oligonucleotide
tacttaaagtgctggctaaa

SEQ ID NO: 1350 - DNA, 20 bp, Artificial sequence
  Synthetic oligonucleotide
ttacttaaagtgctggctaa

SEQ ID NO: 1351 - DNA, 20 bp, Artificial sequence
  Synthetic oligonucleotide
tttacttaaagtgctggcta

SEQ ID NO: 1352 - DNA, 20 bp, Artificial sequence
  Synthetic oligonucleotide
ctttacttaaagtgctggct

SEQ ID NO: 1353 - DNA, 20 bp, Artificial sequence
  Synthetic oligonucleotide
gaccagattctttacttaaa

SEQ ID NO: 1354 - DNA, 20 bp, Artificial sequence
  Synthetic oligonucleotide
tgaccagattctttacttaa

SEQ ID NO: 1355 - DNA, 20 bp, Artificial sequence
  Synthetic oligonucleotide
ttgaccagattctttactta

SEQ ID NO: 1356 - DNA, 20 bp, Artificial sequence
  Synthetic oligonucleotide
attgaccagattctttactt

SEQ ID NO: 1357 - DNA, 20 bp, Artificial sequence
  Synthetic oligonucleotide
aattgaccagattctttact

SEQ ID NO: 1358 - DNA, 20 bp, Artificial sequence
  Synthetic oligonucleotide
caattgaccagattctttac

SEQ ID NO: 1359 - DNA, 20 bp, Artificial sequence
  Synthetic oligonucleotide
gcaattgaccagattcttta

SEQ ID NO: 1360 - DNA, 20 bp, Artificial sequence
  Synthetic oligonucleotide
ggcaattgaccagattcttt

SEQ ID NO: 1361 - DNA, 20 bp, Artificial sequence
  Synthetic oligonucleotide
atattcgttctgcaattttt

SEQ ID NO: 1362 - DNA, 20 bp, Artificial sequence
  Synthetic oligonucleotide
tatattcgttctgcaatttt

SEQ ID NO: 1363 - DNA, 20 bp, Artificial sequence
  Synthetic oligonucleotide
ttatattcgttctgcaattt

SEQ ID NO: 1364 - DNA, 20 bp, Artificial sequence
  Synthetic oligonucleotide
cttatattcgttctgcaatt

SEQ ID NO: 1365 - DNA, 20 bp, Artificial sequence
  Synthetic oligonucleotide
acttatattcgttctgcaat

SEQ ID NO: 1366 - DNA, 20 bp, Artificial sequence
  Synthetic oligonucleotide
aacttatattcgttctgcaa

SEQ ID NO: 1367 - DNA, 20 bp, Artificial sequence
  Synthetic oligonucleotide
taacttatattcgttctgca

SEQ ID NO: 1368 - DNA, 20 bp, Artificial sequence
  Synthetic oligonucleotide
ataacttatattcgttctgc

SEQ ID NO: 1369 - DNA, 20 bp, Artificial sequence
  Synthetic oligonucleotide
cataacttatattcgttctg

SEQ ID NO: 1370 - DNA, 20 bp, Artificial sequence
  Synthetic oligonucleotide
ccataacttatattcgttct

SEQ ID NO: 1371 - DNA, 20 bp, Artificial sequence
  Synthetic oligonucleotide
cccataacttatattcgttc

SEQ ID NO: 1372 - DNA, 20 bp, Artificial sequence
  Synthetic oligonucleotide
gcccataacttatattcgtt

SEQ ID NO: 1373 - DNA, 20 bp, Artificial sequence
  Synthetic oligonucleotide
agcccataacttatattcgt

SEQ ID NO: 1374 - DNA, 20 bp, Artificial sequence
  Synthetic oligonucleotide
tagcccataacttatattcg

SEQ ID NO: 1375 - DNA, 20 bp, Artificial sequence
  Synthetic oligonucleotide
ctagcccataacttatattc

SEQ ID NO: 1376 - DNA, 20 bp, Artificial sequence
  Synthetic oligonucleotide
tctagcccataacttatatt

SEQ ID NO: 1377 - DNA, 20 bp, Artificial sequence
  Synthetic oligonucleotide
ctctagcccataacttatat

SEQ ID NO: 1378 - DNA, 20 bp, Artificial sequence
  Synthetic oligonucleotide
tctctagcccataacttata

SEQ ID NO: 1379 - DNA, 20 bp, Artificial sequence
  Synthetic oligonucleotide
ttctctagcccataacttat

SEQ ID NO: 1380 - DNA, 20 bp, Artificial sequence
  Synthetic oligonucleotide
attctctagcccataactta

SEQ ID NO: 1381 - DNA, 20 bp, Artificial sequence
  Synthetic oligonucleotide
cattctctagcccataactt

SEQ ID NO: 1382 - DNA, 20 bp, Artificial sequence
  Synthetic oligonucleotide
tcattctctagcccataact

SEQ ID NO: 1383 - DNA, 20 bp, Artificial sequence
  Synthetic oligonucleotide
ttcattctctagcccataac

SEQ ID NO: 1384 - DNA, 20 bp, Artificial sequence
  Synthetic oligonucleotide
gttcattctctagcccataa

SEQ ID NO: 1385 - DNA, 20 bp, Artificial sequence
  Synthetic oligonucleotide
ggttcattctctagcccata

SEQ ID NO: 1386 - DNA, 20 bp, Artificial sequence
  Synthetic oligonucleotide
aggttcattctctagcccat

SEQ ID NO: 1387 - DNA, 20 bp, Artificial sequence
  Synthetic oligonucleotide
taggttcattctctagccca

SEQ ID NO: 1388 - DNA, 20 bp, Artificial sequence
  Synthetic oligonucleotide
gtaggttcattctctagccc

SEQ ID NO: 1389 - DNA, 20 bp, Artificial sequence
  Synthetic oligonucleotide
tgtaggttcattctctagcc

SEQ ID NO: 1390 - DNA, 20 bp, Artificial sequence
  Synthetic oligonucleotide
ctgtaggttcattctctagc

SEQ ID NO: 1391 - DNA, 20 bp, Artificial sequence
  Synthetic oligonucleotide
gctgtaggttcattctctag

SEQ ID NO: 1392 - DNA, 20 bp, Artificial sequence
  Synthetic oligonucleotide
tgctgtaggttcattctcta

SEQ ID NO: 1393 - DNA, 20 bp, Artificial sequence
  Synthetic oligonucleotide
ttgctgtaggttcattctct

SEQ ID NO: 1394 - DNA, 20 bp, Artificial sequence
  Synthetic oligonucleotide
gttgctgtaggttcattctc

SEQ ID NO: 1395 - DNA, 20 bp, Artificial sequence
  Synthetic oligonucleotide
agttgctgtaggttcattct

SEQ ID NO: 1396 - DNA, 20 bp, Artificial sequence
  Synthetic oligonucleotide
aagttgctgtaggttcattc

SEQ ID NO: 1397 - DNA, 20 bp, Artificial sequence
  Synthetic oligonucleotide
taagttgctgtaggttcatt

SEQ ID NO: 1398 - DNA, 20 bp, Artificial sequence
  Synthetic oligonucleotide
ataagttgctgtaggttcat

SEQ ID NO: 1399 - DNA, 20 bp, Artificial sequence
  Synthetic oligonucleotide
tataagttgctgtaggttca

SEQ ID NO: 1400 - DNA, 20 bp, Artificial sequence
  Synthetic oligonucleotide
gtataagttgctgtaggttc

SEQ ID NO: 1401 - DNA, 20 bp, Artificial sequence
  Synthetic oligonucleotide
tgtataagttgctgtaggtt

SEQ ID NO: 1402 - DNA, 20 bp, Artificial sequence
  Synthetic oligonucleotide
ttgtataagttgctgtaggt

SEQ ID NO: 1403 - DNA, 20 bp, Artificial sequence
  Synthetic oligonucleotide
attgtataagttgctgtagg

SEQ ID NO: 1404 - DNA, 20 bp, Artificial sequence
  Synthetic oligonucleotide
cattgtataagttgctgtag

SEQ ID NO: 1405 - DNA, 20 bp, Artificial sequence
  Synthetic oligonucleotide
acattgtataagttgctgta

SEQ ID NO: 1406 - DNA, 20 bp, Artificial sequence
  Synthetic oligonucleotide
aacattgtataagttgctgt

SEQ ID NO: 1407 - DNA, 20 bp, Artificial sequence
  Synthetic oligonucleotide
aaacattgtataagttgctg

SEQ ID NO: 1408 - DNA, 20 bp, Artificial sequence
  Synthetic oligonucleotide
aaaacattgtataagttgct

SEQ ID NO: 1409 - DNA, 20 bp, Artificial sequence
  Synthetic oligonucleotide
gaaaacattgtataagttgc

SEQ ID NO: 1410 - DNA, 20 bp, Artificial sequence
  Synthetic oligonucleotide
agaaaacattgtataagttg

SEQ ID NO: 1411 - DNA, 20 bp, Artificial sequence
  Synthetic oligonucleotide
cagaaaacattgtataagtt

SEQ ID NO: 1412 - DNA, 20 bp, Artificial sequence
  Synthetic oligonucleotide
gcagaaaacattgtataagt

SEQ ID NO: 1413 - DNA, 20 bp, Artificial sequence
  Synthetic oligonucleotide
agcagaaaacattgtataag

SEQ ID NO: 1414 - DNA, 20 bp, Artificial sequence
  Synthetic oligonucleotide
aagcagaaaacattgtataa

SEQ ID NO: 1415 - DNA, 20 bp, Artificial sequence
  Synthetic oligonucleotide
aaagcagaaaacattgtata

SEQ ID NO: 1416 - DNA, 20 bp, Artificial sequence
  Synthetic oligonucleotide
aaaagcagaaaacattgtat

SEQ ID NO: 1417 - DNA, 20 bp, Artificial sequence
  Synthetic oligonucleotide
gaaaagcagaaaacattgta

SEQ ID NO: 1418 - DNA, 20 bp, Artificial sequence
  Synthetic oligonucleotide
tgaaaagcagaaaacattgt

SEQ ID NO: 1419 - DNA, 20 bp, Artificial sequence
  Synthetic oligonucleotide
tgctaccttcctgaaaagca

SEQ ID NO: 1420 - DNA, 20 bp, Artificial sequence
  Synthetic oligonucleotide
ttgctaccttcctgaaaagc

SEQ ID NO: 1421 - DNA, 20 bp, Artificial sequence
  Synthetic oligonucleotide
tttgctaccttcctgaaaag

SEQ ID NO: 1422 - DNA, 20 bp, Artificial sequence
  Synthetic oligonucleotide
ttttgctaccttcctgaaaa

SEQ ID NO: 1423 - DNA, 20 bp, Artificial sequence
  Synthetic oligonucleotide
tttttgctaccttcctgaaa

SEQ ID NO: 1424 - DNA, 20 bp, Artificial sequence
  Synthetic oligonucleotide
gcaatctgtttgtgattttt

SEQ ID NO: 1425 - DNA, 20 bp, Artificial sequence
  Synthetic oligonucleotide
tgcaatctgtttgtgatttt

SEQ ID NO: 1426 - DNA, 20 bp, Artificial sequence
  Synthetic oligonucleotide
atgcaatctgtttgtgattt

SEQ ID NO: 1427 - DNA, 20 bp, Artificial sequence
  Synthetic oligonucleotide
tatgcaatctgtttgtgatt

SEQ ID NO: 1428 - DNA, 20 bp, Artificial sequence
  Synthetic oligonucleotide
atatgcaatctgtttgtgat

SEQ ID NO: 1429 - DNA, 20 bp, Artificial sequence
  Synthetic oligonucleotide
aatatgcaatctgtttgtga

SEQ ID NO: 1430 - DNA, 20 bp, Artificial sequence
  Synthetic oligonucleotide
taatatgcaatctgtttgtg

SEQ ID NO: 1431 - DNA, 20 bp, Artificial sequence
  Synthetic oligonucleotide
ataatatgcaatctgtttgt

SEQ ID NO: 1432 - DNA, 20 bp, Artificial sequence
  Synthetic oligonucleotide
agataatatgcaatctgttt

SEQ ID NO: 1433 - DNA, 20 bp, Artificial sequence
  Synthetic oligonucleotide
tatcagataatatgcaatct

SEQ ID NO: 1434 - DNA, 20 bp, Artificial sequence
  Synthetic oligonucleotide
gtatcagataatatgcaatc

SEQ ID NO: 1435 - DNA, 20 bp, Artificial sequence
  Synthetic oligonucleotide
tgtatcagataatatgcaat

SEQ ID NO: 1436 - DNA, 20 bp, Artificial sequence
  Synthetic oligonucleotide
atgtatcagataatatgcaa

SEQ ID NO: 1437 - DNA, 20 bp, Artificial sequence
  Synthetic oligonucleotide
gatgtatcagataatatgca

SEQ ID NO: 1438 - DNA, 20 bp, Artificial sequence
  Synthetic oligonucleotide
ggatgtatcagataatatgc

SEQ ID NO: 1439 - DNA, 20 bp, Artificial sequence
  Synthetic oligonucleotide
gggatgtatcagataatatg

SEQ ID NO: 1440 - DNA, 20 bp, Artificial sequence
  Synthetic oligonucleotide
gaaacgtgtctataccaggg

SEQ ID NO: 1441 - DNA, 20 bp, Artificial sequence
  Synthetic oligonucleotide
ggaaacgtgtctataccagg

SEQ ID NO: 1442 - DNA, 20 bp, Artificial sequence
  Synthetic oligonucleotide
tggaaacgtgtctataccag

SEQ ID NO: 1443 - DNA, 20 bp, Artificial sequence
  Synthetic oligonucleotide
ttggaaacgtgtctatacca

SEQ ID NO: 1444 - DNA, 20 bp, Artificial sequence
  Synthetic oligonucleotide
attggaaacgtgtctatacc

SEQ ID NO: 1445 - DNA, 20 bp, Artificial sequence
  Synthetic oligonucleotide
cattggaaacgtgtctatac

SEQ ID NO: 1446 - DNA, 20 bp, Artificial sequence
  Synthetic oligonucleotide
tcattggaaacgtgtctata

SEQ ID NO: 1447 - DNA, 20 bp, Artificial sequence
  Synthetic oligonucleotide
atcattggaaacgtgtctat

SEQ ID NO: 1448 - DNA, 20 bp, Artificial sequence
  Synthetic oligonucleotide
tatcattggaaacgtgtcta

SEQ ID NO: 1449 - DNA, 20 bp, Artificial sequence
  Synthetic oligonucleotide
ctatcattggaaacgtgtct

SEQ ID NO: 1450 - DNA, 20 bp, Artificial sequence
  Synthetic oligonucleotide
actatcattggaaacgtgtc

SEQ ID NO: 1451 - DNA, 20 bp, Artificial sequence
  Synthetic oligonucleotide
tactatcattggaaacgtgt

SEQ ID NO: 1452 - DNA, 20 bp, Artificial sequence
  Synthetic oligonucleotide
ctactatcattggaaacgtg

SEQ ID NO: 1453 - DNA, 20 bp, Artificial sequence
  Synthetic oligonucleotide
cctactatcattggaaacgt

SEQ ID NO: 1454 - DNA, 20 bp, Artificial sequence
  Synthetic oligonucleotide
tcctactatcattggaaacg

SEQ ID NO: 1455 - DNA, 20 bp, Artificial sequence
  Synthetic oligonucleotide
ttcctactatcattggaaac

SEQ ID NO: 1456 - DNA, 20 bp, Artificial sequence
  Synthetic oligonucleotide
ttttcctactatcattggaa

SEQ ID NO: 1457 - DNA, 20 bp, Artificial sequence
  Synthetic oligonucleotide
gttttcctactatcattgga

SEQ ID NO: 1458 - DNA, 20 bp, Artificial sequence
  Synthetic oligonucleotide
tgttttcctactatcattgg

SEQ ID NO: 1459 - DNA, 20 bp, Artificial sequence
  Synthetic oligonucleotide
ctgttttcctactatcattg

SEQ ID NO: 1460 - DNA, 20 bp, Artificial sequence
  Synthetic oligonucleotide
tctgttttcctactatcatt

SEQ ID NO: 1461 - DNA, 20 bp, Artificial sequence
  Synthetic oligonucleotide
atctgttttcctactatcat

SEQ ID NO: 1462 - DNA, 20 bp, Artificial sequence
  Synthetic oligonucleotide
tatctgttttcctactatca

SEQ ID NO: 1463 - DNA, 20 bp, Artificial sequence
  Synthetic oligonucleotide
ttatctgttttcctactatc

SEQ ID NO: 1464 - DNA, 20 bp, Artificial sequence
  Synthetic oligonucleotide
tttatctgttttcctactat

SEQ ID NO: 1465 - DNA, 20 bp, Artificial sequence
  Synthetic oligonucleotide
atttatctgttttcctacta

SEQ ID NO: 1466 - DNA, 20 bp, Artificial sequence
  Synthetic oligonucleotide
aatttatctgttttcctact

SEQ ID NO: 1467 - DNA, 20 bp, Artificial sequence
  Synthetic oligonucleotide
taatttatctgttttcctac

SEQ ID NO: 1468 - DNA, 20 bp, Artificial sequence
  Synthetic oligonucleotide
gaaaccaattaatttatctg

SEQ ID NO: 1469 - DNA, 20 bp, Artificial sequence
  Synthetic oligonucleotide
gagaaaccaattaatttatc

SEQ ID NO: 1470 - DNA, 20 bp, Artificial sequence
  Synthetic oligonucleotide
ggacgattggtttggagaaa

SEQ ID NO: 1471 - DNA, 20 bp, Artificial sequence
  Synthetic oligonucleotide
cggacgattggtttggagaa

SEQ ID NO: 1472 - DNA, 20 bp, Artificial sequence
  Synthetic oligonucleotide
acggacgattggtttggaga

SEQ ID NO: 1473 - DNA, 20 bp, Artificial sequence
  Synthetic oligonucleotide
tacggacgattggtttggag

SEQ ID NO: 1474 - DNA, 20 bp, Artificial sequence
  Synthetic oligonucleotide
ttacggacgattggtttgga

SEQ ID NO: 1475 - DNA, 20 bp, Artificial sequence
  Synthetic oligonucleotide
cttacggacgattggtttgg

SEQ ID NO: 1476 - DNA, 20 bp, Artificial sequence
  Synthetic oligonucleotide
tcttacggacgattggtttg

SEQ ID NO: 1477 - DNA, 20 bp, Artificial sequence
  Synthetic oligonucleotide
ttcttacggacgattggttt

SEQ ID NO: 1478 - DNA, 20 bp, Artificial sequence
  Synthetic oligonucleotide
cttcttacggacgattggtt

SEQ ID NO: 1479 - DNA, 20 bp, Artificial sequence
  Synthetic oligonucleotide
gcttcttacggacgattggt

SEQ ID NO: 1480 - DNA, 20 bp, Artificial sequence
  Synthetic oligonucleotide
agcttcttacggacgattgg

SEQ ID NO: 1481 - DNA, 20 bp, Artificial sequence
  Synthetic oligonucleotide
tagcttcttacggacgattg

SEQ ID NO: 1482 - DNA, 20 bp, Artificial sequence
  Synthetic oligonucleotide
ttagcttcttacggacgatt

SEQ ID NO: 1483 - DNA, 20 bp, Artificial sequence
  Synthetic oligonucleotide
cttagcttcttacggacgat

SEQ ID NO: 1484 - DNA, 20 bp, Artificial sequence
  Synthetic oligonucleotide
gcttagcttcttacggacga

SEQ ID NO: 1485 - DNA, 20 bp, Artificial sequence
  Synthetic oligonucleotide
agcttagcttcttacggacg

SEQ ID NO: 1486 - DNA, 20 bp, Artificial sequence
  Synthetic oligonucleotide
gctgtgaactcaagcttagc

SEQ ID NO: 1487 - DNA, 20 bp, Artificial sequence
  Synthetic oligonucleotide
agctgtgaactcaagcttag

SEQ ID NO: 1488 - DNA, 20 bp, Artificial sequence
  Synthetic oligonucleotide
tagctgtgaactcaagctta

SEQ ID NO: 1489 - DNA, 20 bp, Artificial sequence
  Synthetic oligonucleotide
ctagctgtgaactcaagctt

SEQ ID NO: 1490 - DNA, 20 bp, Artificial sequence
  Synthetic oligonucleotide
tcctagctgtgaactcaagc

SEQ ID NO: 1491 - DNA, 20 bp, Artificial sequence
  Synthetic oligonucleotide
atcctagctgtgaactcaag

SEQ ID NO: 1492 - DNA, 20 bp, Artificial sequence
  Synthetic oligonucleotide
gatcctagctgtgaactcaa

SEQ ID NO: 1493 - DNA, 20 bp, Artificial sequence
  Synthetic oligonucleotide
agatcctagctgtgaactca

SEQ ID NO: 1494 - DNA, 20 bp, Artificial sequence
  Synthetic oligonucleotide
aagatcctagctgtgaactc

SEQ ID NO: 1495 - DNA, 20 bp, Artificial sequence
  Synthetic oligonucleotide
aaagatcctagctgtgaact

SEQ ID NO: 1496 - DNA, 20 bp, Artificial sequence
  Synthetic oligonucleotide
taaagatcctagctgtgaac

SEQ ID NO: 1497 - DNA, 20 bp, Artificial sequence
  Synthetic oligonucleotide
ctaaagatcctagctgtgaa

SEQ ID NO: 1498 - DNA, 20 bp, Artificial sequence
  Synthetic oligonucleotide
tctaaagatcctagctgtga

SEQ ID NO: 1499 - DNA, 20 bp, Artificial sequence
  Synthetic oligonucleotide
ctctaaagatcctagctgtg

SEQ ID NO: 1500 - DNA, 20 bp, Artificial sequence
  Synthetic oligonucleotide
tctctaaagatcctagctgt

SEQ ID NO: 1501 - DNA, 20 bp, Artificial sequence
  Synthetic oligonucleotide
ttctctaaagatcctagctg

SEQ ID NO: 1502 - DNA, 20 bp, Artificial sequence
  Synthetic oligonucleotide
cttctctaaagatcctagct

SEQ ID NO: 1503 - DNA, 20 bp, Artificial sequence
  Synthetic oligonucleotide
acttctctaaagatcctagc

SEQ ID NO: 1504 - DNA, 20 bp, Artificial sequence
  Synthetic oligonucleotide
aacttctctaaagatcctag

SEQ ID NO: 1505 - DNA, 20 bp, Artificial sequence
  Synthetic oligonucleotide
aaacttctctaaagatccta

SEQ ID NO: 1506 - DNA, 20 bp, Artificial sequence
  Synthetic oligonucleotide
taaacttctctaaagatcct

SEQ ID NO: 1507 - DNA, 20 bp, Artificial sequence
  Synthetic oligonucleotide
ttaaacttctctaaagatcc

SEQ ID NO: 1508 - DNA, 20 bp, Artificial sequence
  Synthetic oligonucleotide
cttaaacttctctaaagatc

SEQ ID NO: 1509 - DNA, 20 bp, Artificial sequence
  Synthetic oligonucleotide
tcttaaacttctctaaagat

SEQ ID NO: 1510 - DNA, 20 bp, Artificial sequence
  Synthetic oligonucleotide
ctcttaaacttctctaaaga

SEQ ID NO: 1511 - DNA, 20 bp, Artificial sequence
  Synthetic oligonucleotide
cctcttaaacttctctaaag

SEQ ID NO: 1512 - DNA, 20 bp, Artificial sequence
  Synthetic oligonucleotide
gcctcttaaacttctctaaa

SEQ ID NO: 1513 - DNA, 20 bp, Artificial sequence
  Synthetic oligonucleotide
tgcctcttaaacttctctaa

SEQ ID NO: 1514 - DNA, 20 bp, Artificial sequence
  Synthetic oligonucleotide
ttgcctcttaaacttctcta

SEQ ID NO: 1515 - DNA, 20 bp, Artificial sequence
  Synthetic oligonucleotide
attgcctcttaaacttctct

SEQ ID NO: 1516 - DNA, 20 bp, Artificial sequence
  Synthetic oligonucleotide
tattgcctcttaaacttctc

SEQ ID NO: 1517 - DNA, 20 bp, Artificial sequence
  Synthetic oligonucleotide
atattgcctcttaaacttct

SEQ ID NO: 1518 - DNA, 20 bp, Artificial sequence
  Synthetic oligonucleotide
catattgcctcttaaacttc

SEQ ID NO: 1519 - DNA, 20 bp, Artificial sequence
  Synthetic oligonucleotide
ccatattgcctcttaaactt

SEQ ID NO: 1520 - DNA, 20 bp, Artificial sequence
  Synthetic oligonucleotide
cccatattgcctcttaaact

SEQ ID NO: 1521 - DNA, 20 bp, Artificial sequence
  Synthetic oligonucleotide
tcccatattgcctcttaaac

SEQ ID NO: 1522 - DNA, 20 bp, Artificial sequence
  Synthetic oligonucleotide
ttcccatattgcctcttaaa

SEQ ID NO: 1523 - DNA, 20 bp, Artificial sequence
  Synthetic oligonucleotide
cttcccatattgcctcttaa

SEQ ID NO: 1524 - DNA, 20 bp, Artificial sequence
  Synthetic oligonucleotide
ccttcccatattgcctctta

SEQ ID NO: 1525 - DNA, 20 bp, Artificial sequence
  Synthetic oligonucleotide
accttcccatattgcctctt

SEQ ID NO: 1526 - DNA, 20 bp, Artificial sequence
  Synthetic oligonucleotide
aaccttcccatattgcctct

SEQ ID NO: 1527 - DNA, 20 bp, Artificial sequence
  Synthetic oligonucleotide
caaccttcccatattgcctc

SEQ ID NO: 1528 - DNA, 20 bp, Artificial sequence
  Synthetic oligonucleotide
tcaaccttcccatattgcct

SEQ ID NO: 1529 - DNA, 20 bp, Artificial sequence
  Synthetic oligonucleotide
ttcaaccttcccatattgcc

SEQ ID NO: 1530 - DNA, 20 bp, Artificial sequence
  Synthetic oligonucleotide
tttcaaccttcccatattgc

SEQ ID NO: 1531 - DNA, 20 bp, Artificial sequence
  Synthetic oligonucleotide
ttttcaaccttcccatattg

SEQ ID NO: 1532 - DNA, 20 bp, Artificial sequence
  Synthetic oligonucleotide
attttcaaccttcccatatt

SEQ ID NO: 1533 - DNA, 20 bp, Artificial sequence
  Synthetic oligonucleotide
gattttcaaccttcccatat

SEQ ID NO: 1534 - DNA, 20 bp, Artificial sequence
  Synthetic oligonucleotide
ggattttcaaccttcccata

SEQ ID NO: 1535 - DNA, 20 bp, Artificial sequence
  Synthetic oligonucleotide
aggattttcaaccttcccat

SEQ ID NO: 1536 - DNA, 20 bp, Artificial sequence
  Synthetic oligonucleotide
gaggattttcaaccttccca

SEQ ID NO: 1537 - DNA, 20 bp, Artificial sequence
  Synthetic oligonucleotide
agaggattttcaaccttccc

SEQ ID NO: 1538 - DNA, 20 bp, Artificial sequence
  Synthetic oligonucleotide
cagaggattttcaaccttcc

SEQ ID NO: 1539 - DNA, 20 bp, Artificial sequence
  Synthetic oligonucleotide
ccagaggattttcaaccttc

SEQ ID NO: 1540 - DNA, 20 bp, Artificial sequence
  Synthetic oligonucleotide
tccagaggattttcaacctt

SEQ ID NO: 1541 - DNA, 20 bp, Artificial sequence
  Synthetic oligonucleotide
atccagaggattttcaacct

SEQ ID NO: 1542 - DNA, 20 bp, Artificial sequence
  Synthetic oligonucleotide
tatccagaggattttcaacc

SEQ ID NO: 1543 - DNA, 20 bp, Artificial sequence
  Synthetic oligonucleotide
gtatccagaggattttcaac

SEQ ID NO: 1544 - DNA, 20 bp, Artificial sequence
  Synthetic oligonucleotide
tgtatccagaggattttcaa

SEQ ID NO: 1545 - DNA, 20 bp, Artificial sequence
  Synthetic oligonucleotide
ctgtatccagaggattttca

SEQ ID NO: 1546 - DNA, 20 bp, Artificial sequence
  Synthetic oligonucleotide
ttcctctacttctgtatcca

SEQ ID NO: 1547 - DNA, 20 bp, Artificial sequence
  Synthetic oligonucleotide
tttcctctacttctgtatcc

SEQ ID NO: 1548 - DNA, 20 bp, Artificial sequence
  Synthetic oligonucleotide
ctttcctctacttctgtatc

SEQ ID NO: 1549 - DNA, 20 bp, Artificial sequence
  Synthetic oligonucleotide
actttcctctacttctgtat

SEQ ID NO: 1550 - DNA, 20 bp, Artificial sequence
  Synthetic oligonucleotide
tactttcctctacttctgta

SEQ ID NO: 1551 - DNA, 20 bp, Artificial sequence
  Synthetic oligonucleotide
ttactttcctctacttctgt

SEQ ID NO: 1552 - DNA, 20 bp, Artificial sequence
  Synthetic oligonucleotide
attactttcctctacttctg

SEQ ID NO: 1553 - DNA, 20 bp, Artificial sequence
  Synthetic oligonucleotide
cattactttcctctacttct

SEQ ID NO: 1554 - DNA, 20 bp, Artificial sequence
  Synthetic oligonucleotide
ccattactttcctctacttc

SEQ ID NO: 1555 - DNA, 20 bp, Artificial sequence
  Synthetic oligonucleotide
tccattactttcctctactt

SEQ ID NO: 1556 - DNA, 20 bp, Artificial sequence
  Synthetic oligonucleotide
ctccattactttcctctact

SEQ ID NO: 1557 - DNA, 20 bp, Artificial sequence
  Synthetic oligonucleotide
actccattactttcctctac

SEQ ID NO: 1558 - DNA, 20 bp, Artificial sequence
  Synthetic oligonucleotide
gactccattactttcctcta

SEQ ID NO: 1559 - DNA, 20 bp, Artificial sequence
  Synthetic oligonucleotide
tgactccattactttcctct

SEQ ID NO: 1560 - DNA, 20 bp, Artificial sequence
  Synthetic oligonucleotide
gtgactccattactttcctc

SEQ ID NO: 1561 - DNA, 20 bp, Artificial sequence
  Synthetic oligonucleotide
agtgactccattactttcct

SEQ ID NO: 1562 - DNA, 20 bp, Artificial sequence
  Synthetic oligonucleotide
tagtgactccattactttcc

SEQ ID NO: 1563 - DNA, 20 bp, Artificial sequence
  Synthetic oligonucleotide
gtagtgactccattactttc

SEQ ID NO: 1564 - DNA, 20 bp, Artificial sequence
  Synthetic oligonucleotide
ggtagtgactccattacttt

SEQ ID NO: 1565 - DNA, 20 bp, Artificial sequence
  Synthetic oligonucleotide
tggtagtgactccattactt

SEQ ID NO: 1566 - DNA, 20 bp, Artificial sequence
  Synthetic oligonucleotide
ttggtagtgactccattact

SEQ ID NO: 1567 - DNA, 20 bp, Artificial sequence
  Synthetic oligonucleotide
attggtagtgactccattac

SEQ ID NO: 1568 - DNA, 20 bp, Artificial sequence
  Synthetic oligonucleotide
gattggtagtgactccatta

SEQ ID NO: 1569 - DNA, 20 bp, Artificial sequence
  Synthetic oligonucleotide
agattggtagtgactccatt

SEQ ID NO: 1570 - DNA, 20 bp, Artificial sequence
  Synthetic oligonucleotide
gagattggtagtgactccat

SEQ ID NO: 1571 - DNA, 20 bp, Artificial sequence
  Synthetic oligonucleotide
tgagattggtagtgactcca

SEQ ID NO: 1572 - DNA, 20 bp, Artificial sequence
  Synthetic oligonucleotide
ctgagattggtagtgactcc

SEQ ID NO: 1573 - DNA, 20 bp, Artificial sequence
  Synthetic oligonucleotide
actgagattggtagtgactc

SEQ ID NO: 1574 - DNA, 20 bp, Artificial sequence
  Synthetic oligonucleotide
gactgagattggtagtgact

SEQ ID NO: 1575 - DNA, 20 bp, Artificial sequence
  Synthetic oligonucleotide
agactgagattggtagtgac

SEQ ID NO: 1576 - DNA, 20 bp, Artificial sequence
  Synthetic oligonucleotide
aagactgagattggtagtga

SEQ ID NO: 1577 - DNA, 20 bp, Artificial sequence
  Synthetic oligonucleotide
gaagactgagattggtagtg

SEQ ID NO: 1578 - DNA, 20 bp, Artificial sequence
  Synthetic oligonucleotide
tgaagactgagattggtagt

SEQ ID NO: 1579 - DNA, 20 bp, Artificial sequence
  Synthetic oligonucleotide
ttgaagactgagattggtag

SEQ ID NO: 1580 - DNA, 20 bp, Artificial sequence
  Synthetic oligonucleotide
cttgaagactgagattggta

SEQ ID NO: 1581 - DNA, 20 bp, Artificial sequence
  Synthetic oligonucleotide
acttgaagactgagattggt

SEQ ID NO: 1582 - DNA, 20 bp, Artificial sequence
  Synthetic oligonucleotide
aacttgaagactgagattgg

SEQ ID NO: 1583 - DNA, 20 bp, Artificial sequence
  Synthetic oligonucleotide
caacttgaagactgagattg

SEQ ID NO: 1584 - DNA, 20 bp, Artificial sequence
  Synthetic oligonucleotide
tcaacttgaagactgagatt

SEQ ID NO: 1585 - DNA, 20 bp, Artificial sequence
  Synthetic oligonucleotide
ttcaacttgaagactgagat

SEQ ID NO: 1586 - DNA, 20 bp, Artificial sequence
  Synthetic oligonucleotide
gttcaacttgaagactgaga

SEQ ID NO: 1587 - DNA, 20 bp, Artificial sequence
  Synthetic oligonucleotide
ggttcaacttgaagactgag

SEQ ID NO: 1588 - DNA, 20 bp, Artificial sequence
  Synthetic oligonucleotide
aggttcaacttgaagactga

SEQ ID NO: 1589 - DNA, 20 bp, Artificial sequence
  Synthetic oligonucleotide
caggttcaacttgaagactg

SEQ ID NO: 1590 - DNA, 20 bp, Artificial sequence
  Synthetic oligonucleotide
tcaggttcaacttgaagact

SEQ ID NO: 1591 - DNA, 20 bp, Artificial sequence
  Synthetic oligonucleotide
gtcaggttcaacttgaagac

SEQ ID NO: 1592 - DNA, 20 bp, Artificial sequence
  Synthetic oligonucleotide
tgtcaggttcaacttgaaga

SEQ ID NO: 1593 - DNA, 20 bp, Artificial sequence
  Synthetic oligonucleotide
atgtcaggttcaacttgaag

SEQ ID NO: 1594 - DNA, 20 bp, Artificial sequence
  Synthetic oligonucleotide
aatgtcaggttcaacttgaa

SEQ ID NO: 1595 - DNA, 20 bp, Artificial sequence
  Synthetic oligonucleotide
gaatgtcaggttcaacttga

SEQ ID NO: 1596 - DNA, 20 bp, Artificial sequence
  Synthetic oligonucleotide
agaatgtcaggttcaacttg

SEQ ID NO: 1597 - DNA, 20 bp, Artificial sequence
  Synthetic oligonucleotide
cagaatgtcaggttcaactt

SEQ ID NO: 1598 - DNA, 20 bp, Artificial sequence
  Synthetic oligonucleotide
ttcttgtccttcagcagaat

SEQ ID NO: 1599 - DNA, 20 bp, Artificial sequence
  Synthetic oligonucleotide
gttcttgtccttcagcagaa

SEQ ID NO: 1600 - DNA, 20 bp, Artificial sequence
  Synthetic oligonucleotide
ggttcttgtccttcagcaga

SEQ ID NO: 1601 - DNA, 20 bp, Artificial sequence
  Synthetic oligonucleotide
cggttcttgtccttcagcag

SEQ ID NO: 1602 - DNA, 20 bp, Artificial sequence
  Synthetic oligonucleotide
gcggttcttgtccttcagca

SEQ ID NO: 1603 - DNA, 20 bp, Artificial sequence
  Synthetic oligonucleotide
agcggttcttgtccttcagc

SEQ ID NO: 1604 - DNA, 20 bp, Artificial sequence
  Synthetic oligonucleotide
aagcggttcttgtccttcag

SEQ ID NO: 1605 - DNA, 20 bp, Artificial sequence
  Synthetic oligonucleotide
taagcggttcttgtccttca

SEQ ID NO: 1606 - DNA, 20 bp, Artificial sequence
  Synthetic oligonucleotide
ctaagcggttcttgtccttc

SEQ ID NO: 1607 - DNA, 20 bp, Artificial sequence
  Synthetic oligonucleotide
tctaagcggttcttgtcctt

SEQ ID NO: 1608 - DNA, 20 bp, Artificial sequence
  Synthetic oligonucleotide
ctctaagcggttcttgtcct

SEQ ID NO: 1609 - DNA, 20 bp, Artificial sequence
  Synthetic oligonucleotide
tctctaagcggttcttgtcc

SEQ ID NO: 1610 - DNA, 20 bp, Artificial sequence
  Synthetic oligonucleotide
ttctctaagcggttcttgtc

SEQ ID NO: 1611 - DNA, 20 bp, Artificial sequence
  Synthetic oligonucleotide
gttctctaagcggttcttgt

SEQ ID NO: 1612 - DNA, 20 bp, Artificial sequence
  Synthetic oligonucleotide
agttctctaagcggttcttg

SEQ ID NO: 1613 - DNA, 20 bp, Artificial sequence
  Synthetic oligonucleotide
agagttctctaagcggttct

SEQ ID NO: 1614 - DNA, 20 bp, Artificial sequence
  Synthetic oligonucleotide
cagagttctctaagcggttc

SEQ ID NO: 1615 - DNA, 20 bp, Artificial sequence
  Synthetic oligonucleotide
tcagagttctctaagcggtt

SEQ ID NO: 1616 - DNA, 20 bp, Artificial sequence
  Synthetic oligonucleotide
atcagagttctctaagcggt

SEQ ID NO: 1617 - DNA, 20 bp, Artificial sequence
  Synthetic oligonucleotide
catcagagttctctaagcgg

SEQ ID NO: 1618 - DNA, 20 bp, Artificial sequence
  Synthetic oligonucleotide
acatcagagttctctaagcg

SEQ ID NO: 1619 - DNA, 20 bp, Artificial sequence
  Synthetic oligonucleotide
aacatcagagttctctaagc

SEQ ID NO: 1620 - DNA, 20 bp, Artificial sequence
  Synthetic oligonucleotide
aaacatcagagttctctaag

SEQ ID NO: 1621 - DNA, 20 bp, Artificial sequence
  Synthetic oligonucleotide
caaacatcagagttctctaa

SEQ ID NO: 1622 - DNA, 20 bp, Artificial sequence
  Synthetic oligonucleotide
acaaacatcagagttctcta

SEQ ID NO: 1623 - DNA, 20 bp, Artificial sequence
  Synthetic oligonucleotide
tacaaacatcagagttctct

SEQ ID NO: 1624 - DNA, 20 bp, Artificial sequence
  Synthetic oligonucleotide
ttacaaacatcagagttctc

SEQ ID NO: 1625 - DNA, 20 bp, Artificial sequence
  Synthetic oligonucleotide
tttacaaacatcagagttct

SEQ ID NO: 1626 - DNA, 20 bp, Artificial sequence
  Synthetic oligonucleotide
ttttacaaacatcagagttc

SEQ ID NO: 1627 - DNA, 20 bp, Artificial sequence
  Synthetic oligonucleotide
attttacaaacatcagagtt

SEQ ID NO: 1628 - DNA, 20 bp, Artificial sequence
  Synthetic oligonucleotide
gattttacaaacatcagagt

SEQ ID NO: 1629 - DNA, 20 bp, Artificial sequence
  Synthetic oligonucleotide
tgattttacaaacatcagag

SEQ ID NO: 1630 - DNA, 20 bp, Artificial sequence
  Synthetic oligonucleotide
gtgattttacaaacatcaga

SEQ ID NO: 1631 - DNA, 20 bp, Artificial sequence
  Synthetic oligonucleotide
agtgattttacaaacatcag

SEQ ID NO: 1632 - DNA, 20 bp, Artificial sequence
  Synthetic oligonucleotide
tagtgattttacaaacatca

SEQ ID NO: 1633 - DNA, 20 bp, Artificial sequence
  Synthetic oligonucleotide
gtagtgattttacaaacatc

SEQ ID NO: 1634 - DNA, 20 bp, Artificial sequence
  Synthetic oligonucleotide
agtagtgattttacaaacat

SEQ ID NO: 1635 - DNA, 20 bp, Artificial sequence
  Synthetic oligonucleotide
tagtagtgattttacaaaca

SEQ ID NO: 1636 - DNA, 20 bp, Artificial sequence
  Synthetic oligonucleotide
atagtagtgattttacaaac

SEQ ID NO: 1637 - DNA, 20 bp, Artificial sequence
  Synthetic oligonucleotide
catagtagtgattttacaaa

SEQ ID NO: 1638 - DNA, 20 bp, Artificial sequence
  Synthetic oligonucleotide
ccatagtagtgattttacaa

SEQ ID NO: 1639 - DNA, 20 bp, Artificial sequence
  Synthetic oligonucleotide
tccatagtagtgattttaca

SEQ ID NO: 1640 - DNA, 20 bp, Artificial sequence
  Synthetic oligonucleotide
ctccatagtagtgattttac

SEQ ID NO: 1641 - DNA, 20 bp, Artificial sequence
  Synthetic oligonucleotide
gctccatagtagtgatttta

SEQ ID NO: 1642 - DNA, 20 bp, Artificial sequence
  Synthetic oligonucleotide
tgctccatagtagtgatttt

SEQ ID NO: 1643 - DNA, 20 bp, Artificial sequence
  Synthetic oligonucleotide
atgctccatagtagtgattt

SEQ ID NO: 1644 - DNA, 20 bp, Artificial sequence
  Synthetic oligonucleotide
tatgctccatagtagtgatt

SEQ ID NO: 1645 - DNA, 20 bp, Artificial sequence
  Synthetic oligonucleotide
ctatgctccatagtagtgat

SEQ ID NO: 1646 - DNA, 20 bp, Artificial sequence
  Synthetic oligonucleotide
ctgaatcactatgctccata

SEQ ID NO: 1647 - DNA, 20 bp, Artificial sequence
  Synthetic oligonucleotide
tctgaatcactatgctccat

SEQ ID NO: 1648 - DNA, 20 bp, Artificial sequence
  Synthetic oligonucleotide
atctgaatcactatgctcca

SEQ ID NO: 1649 - DNA, 20 bp, Artificial sequence
  Synthetic oligonucleotide
tatctgaatcactatgctcc

SEQ ID NO: 1650 - DNA, 20 bp, Artificial sequence
  Synthetic oligonucleotide
ctatctgaatcactatgctc

SEQ ID NO: 1651 - DNA, 20 bp, Artificial sequence
  Synthetic oligonucleotide
actatctgaatcactatgct

SEQ ID NO: 1652 - DNA, 20 bp, Artificial sequence
  Synthetic oligonucleotide
tactatctgaatcactatgc

SEQ ID NO: 1653 - DNA, 20 bp, Artificial sequence
  Synthetic oligonucleotide
ctactatctgaatcactatg

SEQ ID NO: 1654 - DNA, 20 bp, Artificial sequence
  Synthetic oligonucleotide
actactatctgaatcactat

SEQ ID NO: 1655 - DNA, 20 bp, Artificial sequence
  Synthetic oligonucleotide
aactactatctgaatcacta

SEQ ID NO: 1656 - DNA, 20 bp, Artificial sequence
  Synthetic oligonucleotide
caactactatctgaatcact

SEQ ID NO: 1657 - DNA, 20 bp, Artificial sequence
  Synthetic oligonucleotide
acaactactatctgaatcac

SEQ ID NO: 1658 - DNA, 20 bp, Artificial sequence
  Synthetic oligonucleotide
gacaactactatctgaatca

SEQ ID NO: 1659 - DNA, 20 bp, Artificial sequence
  Synthetic oligonucleotide
tgacaactactatctgaatc

SEQ ID NO: 1660 - DNA, 20 bp, Artificial sequence
  Synthetic oligonucleotide
ttgacaactactatctgaat

SEQ ID NO: 1661 - DNA, 20 bp, Artificial sequence
  Synthetic oligonucleotide
gttgacaactactatctgaa

SEQ ID NO: 1662 - DNA, 20 bp, Artificial sequence
  Synthetic oligonucleotide
ggttgacaactactatctga

SEQ ID NO: 1663 - DNA, 20 bp, Artificial sequence
  Synthetic oligonucleotide
tggttgacaactactatctg

SEQ ID NO: 1664 - DNA, 20 bp, Artificial sequence
  Synthetic oligonucleotide
ctggttgacaactactatct

SEQ ID NO: 1665 - DNA, 20 bp, Artificial sequence
  Synthetic oligonucleotide
gctggttgacaactactatc

SEQ ID NO: 1666 - DNA, 20 bp, Artificial sequence
  Synthetic oligonucleotide
tgctggttgacaactactat

SEQ ID NO: 1667 - DNA, 20 bp, Artificial sequence
  Synthetic oligonucleotide
ttgctggttgacaactacta

SEQ ID NO: 1668 - DNA, 20 bp, Artificial sequence
  Synthetic oligonucleotide
cttgctggttgacaactact

SEQ ID NO: 1669 - DNA, 20 bp, Artificial sequence
  Synthetic oligonucleotide
gcttgctggttgacaactac

SEQ ID NO: 1670 - DNA, 20 bp, Artificial sequence
  Synthetic oligonucleotide
ggcttgctggttgacaacta

SEQ ID NO: 1671 - DNA, 20 bp, Artificial sequence
  Synthetic oligonucleotide
tggcttgctggttgacaact

SEQ ID NO: 1672 - DNA, 20 bp, Artificial sequence
  Synthetic oligonucleotide
gtggcttgctggttgacaac

SEQ ID NO: 1673 - DNA, 20 bp, Artificial sequence
  Synthetic oligonucleotide
tgtggcttgctggttgacaa

SEQ ID NO: 1674 - DNA, 20 bp, Artificial sequence
  Synthetic oligonucleotide
atgtggcttgctggttgaca

SEQ ID NO: 1675 - DNA, 20 bp, Artificial sequence
  Synthetic oligonucleotide
gatgtggcttgctggttgac

SEQ ID NO: 1676 - DNA, 20 bp, Artificial sequence
  Synthetic oligonucleotide
ggatgtggcttgctggttga

SEQ ID NO: 1677 - DNA, 20 bp, Artificial sequence
  Synthetic oligonucleotide
aggatgtggcttgctggttg

SEQ ID NO: 1678 - DNA, 20 bp, Artificial sequence
  Synthetic oligonucleotide
aaggatgtggcttgctggtt

SEQ ID NO: 1679 - DNA, 20 bp, Artificial sequence
  Synthetic oligonucleotide
taaggatgtggcttgctggt

SEQ ID NO: 1680 - DNA, 20 bp, Artificial sequence
  Synthetic oligonucleotide
ttaaggatgtggcttgctgg

SEQ ID NO: 1681 - DNA, 20 bp, Artificial sequence
  Synthetic oligonucleotide
gttaaggatgtggcttgctg

SEQ ID NO: 1682 - DNA, 20 bp, Artificial sequence
  Synthetic oligonucleotide
agttaaggatgtggcttgct

SEQ ID NO: 1683 - DNA, 20 bp, Artificial sequence
  Synthetic oligonucleotide
gagttaaggatgtggcttgc

SEQ ID NO: 1684 - DNA, 20 bp, Artificial sequence
  Synthetic oligonucleotide
tgagttaaggatgtggcttg

SEQ ID NO: 1685 - DNA, 20 bp, Artificial sequence
  Synthetic oligonucleotide
ctgagttaaggatgtggctt

SEQ ID NO: 1686 - DNA, 20 bp, Artificial sequence
  Synthetic oligonucleotide
tctgagttaaggatgtggct

SEQ ID NO: 1687 - DNA, 20 bp, Artificial sequence
  Synthetic oligonucleotide
ctctgagttaaggatgtggc

SEQ ID NO: 1688 - DNA, 20 bp, Artificial sequence
  Synthetic oligonucleotide
tctctgagttaaggatgtgg

SEQ ID NO: 1689 - DNA, 20 bp, Artificial sequence
  Synthetic oligonucleotide
ttctctgagttaaggatgtg

SEQ ID NO: 1690 - DNA, 20 bp, Artificial sequence
  Synthetic oligonucleotide
cttctctgagttaaggatgt

SEQ ID NO: 1691 - DNA, 20 bp, Artificial sequence
  Synthetic oligonucleotide
acttctctgagttaaggatg

SEQ ID NO: 1692 - DNA, 20 bp, Artificial sequence
  Synthetic oligonucleotide
aacttctctgagttaaggat

SEQ ID NO: 1693 - DNA, 20 bp, Artificial sequence
  Synthetic oligonucleotide
aaacttctctgagttaagga

SEQ ID NO: 1694 - DNA, 20 bp, Artificial sequence
  Synthetic oligonucleotide
gaaacttctctgagttaagg

SEQ ID NO: 1695 - DNA, 20 bp, Artificial sequence
  Synthetic oligonucleotide
ggaaacttctctgagttaag

SEQ ID NO: 1696 - DNA, 20 bp, Artificial sequence
  Synthetic oligonucleotide
tggaaacttctctgagttaa

SEQ ID NO: 1697 - DNA, 20 bp, Artificial sequence
  Synthetic oligonucleotide
atggaaacttctctgagtta

SEQ ID NO: 1698 - DNA, 20 bp, Artificial sequence
  Synthetic oligonucleotide
gaatggaaacttctctgagt

SEQ ID NO: 1699 - DNA, 20 bp, Artificial sequence
  Synthetic oligonucleotide
agaatggaaacttctctgag

SEQ ID NO: 1700 - DNA, 20 bp, Artificial sequence
  Synthetic oligonucleotide
cttggagaatggaaacttct

SEQ ID NO: 1701 - DNA, 20 bp, Artificial sequence
  Synthetic oligonucleotide
ccttggagaatggaaacttc

SEQ ID NO: 1702 - DNA, 20 bp, Artificial sequence
  Synthetic oligonucleotide
tccttggagaatggaaactt

SEQ ID NO: 1703 - DNA, 20 bp, Artificial sequence
  Synthetic oligonucleotide
atccttggagaatggaaact

SEQ ID NO: 1704 - DNA, 20 bp, Artificial sequence
  Synthetic oligonucleotide
catccttggagaatggaaac

SEQ ID NO: 1705 - DNA, 20 bp, Artificial sequence
  Synthetic oligonucleotide
tcatccttggagaatggaaa

SEQ ID NO: 1706 - DNA, 20 bp, Artificial sequence
  Synthetic oligonucleotide
ttcatccttggagaatggaa

SEQ ID NO: 1707 - DNA, 20 bp, Artificial sequence
  Synthetic oligonucleotide
cttcatccttggagaatgga

SEQ ID NO: 1708 - DNA, 20 bp, Artificial sequence
  Synthetic oligonucleotide
tcttcatccttggagaatgg

SEQ ID NO: 1709 - DNA, 20 bp, Artificial sequence
  Synthetic oligonucleotide
atcttcatccttggagaatg

SEQ ID NO: 1710 - DNA, 20 bp, Artificial sequence
  Synthetic oligonucleotide
aatcttcatccttggagaat

SEQ ID NO: 1711 - DNA, 20 bp, Artificial sequence
  Synthetic oligonucleotide
caatcttcatccttggagaa

SEQ ID NO: 1712 - DNA, 20 bp, Artificial sequence
  Synthetic oligonucleotide
aacaatcttcatccttggag

SEQ ID NO: 1713 - DNA, 20 bp, Artificial sequence
  Synthetic oligonucleotide
aaacaatcttcatccttgga

SEQ ID NO: 1714 - DNA, 20 bp, Artificial sequence
  Synthetic oligonucleotide
taaacaatcttcatccttgg

SEQ ID NO: 1715 - DNA, 20 bp, Artificial sequence
  Synthetic oligonucleotide
ctaaacaatcttcatccttg

SEQ ID NO: 1716 - DNA, 20 bp, Artificial sequence
  Synthetic oligonucleotide
tctaaacaatcttcatcctt

SEQ ID NO: 1717 - DNA, 20 bp, Artificial sequence
  Synthetic oligonucleotide
ttctaaacaatcttcatcct

SEQ ID NO: 1718 - DNA, 20 bp, Artificial sequence
  Synthetic oligonucleotide
gttctaaacaatcttcatcc

SEQ ID NO: 1719 - DNA, 20 bp, Artificial sequence
  Synthetic oligonucleotide
tgttctaaacaatcttcatc

SEQ ID NO: 1720 - DNA, 20 bp, Artificial sequence
  Synthetic oligonucleotide
aggcatctgttgttctaaac

SEQ ID NO: 1721 - DNA, 20 bp, Artificial sequence
  Synthetic oligonucleotide
taggcatctgttgttctaaa

SEQ ID NO: 1722 - DNA, 20 bp, Artificial sequence
  Synthetic oligonucleotide
ctaggcatctgttgttctaa

SEQ ID NO: 1723 - DNA, 20 bp, Artificial sequence
  Synthetic oligonucleotide
actaggcatctgttgttcta

SEQ ID NO: 1724 - DNA, 20 bp, Artificial sequence
  Synthetic oligonucleotide
aactaggcatctgttgttct

SEQ ID NO: 1725 - DNA, 20 bp, Artificial sequence
  Synthetic oligonucleotide
aaactaggcatctgttgttc

SEQ ID NO: 1726 - DNA, 20 bp, Artificial sequence
  Synthetic oligonucleotide
caaactaggcatctgttgtt

SEQ ID NO: 1727 - DNA, 20 bp, Artificial sequence
  Synthetic oligonucleotide
tcaaactaggcatctgttgt

SEQ ID NO: 1728 - DNA, 20 bp, Artificial sequence
  Synthetic oligonucleotide
ctcaaactaggcatctgttg

SEQ ID NO: 1729 - DNA, 20 bp, Artificial sequence
  Synthetic oligonucleotide
tctcaaactaggcatctgtt

SEQ ID NO: 1730 - DNA, 20 bp, Artificial sequence
  Synthetic oligonucleotide
ctctcaaactaggcatctgt

SEQ ID NO: 1731 - DNA, 20 bp, Artificial sequence
  Synthetic oligonucleotide
tctctcaaactaggcatctg

SEQ ID NO: 1732 - DNA, 20 bp, Artificial sequence
  Synthetic oligonucleotide
ttctctcaaactaggcatct

SEQ ID NO: 1733 - DNA, 20 bp, Artificial sequence
  Synthetic oligonucleotide
tttctctcaaactaggcatc

SEQ ID NO: 1734 - DNA, 20 bp, Artificial sequence
  Synthetic oligonucleotide
ctttctctcaaactaggcat

SEQ ID NO: 1735 - DNA, 20 bp, Artificial sequence
  Synthetic oligonucleotide
actttctctcaaactaggca

SEQ ID NO: 1736 - DNA, 20 bp, Artificial sequence
  Synthetic oligonucleotide
gactttctctcaaactaggc

SEQ ID NO: 1737 - DNA, 20 bp, Artificial sequence
  Synthetic oligonucleotide
ggactttctctcaaactagg

SEQ ID NO: 1738 - DNA, 20 bp, Artificial sequence
  Synthetic oligonucleotide
aggactttctctcaaactag

SEQ ID NO: 1739 - DNA, 20 bp, Artificial sequence
  Synthetic oligonucleotide
taggactttctctcaaacta

SEQ ID NO: 1740 - DNA, 20 bp, Artificial sequence
  Synthetic oligonucleotide
ataggactttctctcaaact

SEQ ID NO: 1741 - DNA, 20 bp, Artificial sequence
  Synthetic oligonucleotide
cataggactttctctcaaac

SEQ ID NO: 1742 - DNA, 20 bp, Artificial sequence
  Synthetic oligonucleotide
tcataggactttctctcaaa

SEQ ID NO: 1743 - DNA, 20 bp, Artificial sequence
  Synthetic oligonucleotide
actccttcagggtcatagga

SEQ ID NO: 1744 - DNA, 20 bp, Artificial sequence
  Synthetic oligonucleotide
aactccttcagggtcatagg

SEQ ID NO: 1745 - DNA, 20 bp, Artificial sequence
  Synthetic oligonucleotide
taactccttcagggtcatag

SEQ ID NO: 1746 - DNA, 20 bp, Artificial sequence
  Synthetic oligonucleotide
ataactccttcagggtcata

SEQ ID NO: 1747 - DNA, 20 bp, Artificial sequence
  Synthetic oligonucleotide
gataactccttcagggtcat

SEQ ID NO: 1748 - DNA, 20 bp, Artificial sequence
  Synthetic oligonucleotide
agataactccttcagggtca

SEQ ID NO: 1749 - DNA, 20 bp, Artificial sequence
  Synthetic oligonucleotide
gagataactccttcagggtc

SEQ ID NO: 1750 - DNA, 20 bp, Artificial sequence
  Synthetic oligonucleotide
tctattaaagagagataact

SEQ ID NO: 1751 - DNA, 20 bp, Artificial sequence
  Synthetic oligonucleotide
ttctattaaagagagataac

SEQ ID NO: 1752 - DNA, 20 bp, Artificial sequence
  Synthetic oligonucleotide
gttttctattaaagagagat

SEQ ID NO: 1753 - DNA, 20 bp, Artificial sequence
  Synthetic oligonucleotide
ggttttctattaaagagaga

SEQ ID NO: 1754 - DNA, 20 bp, Artificial sequence
  Synthetic oligonucleotide
aggttttctattaaagagag

SEQ ID NO: 1755 - DNA, 20 bp, Artificial sequence
  Synthetic oligonucleotide
aaggttttctattaaagaga

SEQ ID NO: 1756 - DNA, 20 bp, Artificial sequence
  Synthetic oligonucleotide
aaaggttttctattaaagag

SEQ ID NO: 1757 - DNA, 20 bp, Artificial sequence
  Synthetic oligonucleotide
caaaggttttctattaaaga

SEQ ID NO: 1758 - DNA, 20 bp, Artificial sequence
  Synthetic oligonucleotide
ccaaaggttttctattaaag

SEQ ID NO: 1759 - DNA, 20 bp, Artificial sequence
  Synthetic oligonucleotide
tccaaaggttttctattaaa

SEQ ID NO: 1760 - DNA, 20 bp, Artificial sequence
  Synthetic oligonucleotide
gtccaaaggttttctattaa

SEQ ID NO: 1761 - DNA, 20 bp, Artificial sequence
  Synthetic oligonucleotide
ggtccaaaggttttctatta

SEQ ID NO: 1762 - DNA, 20 bp, Artificial sequence
  Synthetic oligonucleotide
aggtccaaaggttttctatt

SEQ ID NO: 1763 - DNA, 20 bp, Artificial sequence
  Synthetic oligonucleotide
aaggtccaaaggttttctat

SEQ ID NO: 1764 - DNA, 20 bp, Artificial sequence
  Synthetic oligonucleotide
caaggtccaaaggttttcta

SEQ ID NO: 1765 - DNA, 20 bp, Artificial sequence
  Synthetic oligonucleotide
tcaaggtccaaaggttttct

SEQ ID NO: 1766 - DNA, 20 bp, Artificial sequence
  Synthetic oligonucleotide
ctcaaggtccaaaggttttc

SEQ ID NO: 1767 - DNA, 20 bp, Artificial sequence
  Synthetic oligonucleotide
tctcaaggtccaaaggtttt

SEQ ID NO: 1768 - DNA, 20 bp, Artificial sequence
  Synthetic oligonucleotide
ttctcaaggtccaaaggttt

SEQ ID NO: 1769 - DNA, 20 bp, Artificial sequence
  Synthetic oligonucleotide
cttctcaaggtccaaaggtt

SEQ ID NO: 1770 - DNA, 20 bp, Artificial sequence
  Synthetic oligonucleotide
acttctcaaggtccaaaggt

SEQ ID NO: 1771 - DNA, 20 bp, Artificial sequence
  Synthetic oligonucleotide
gacttctcaaggtccaaagg

SEQ ID NO: 1772 - DNA, 20 bp, Artificial sequence
  Synthetic oligonucleotide
tgacttctcaaggtccaaag

SEQ ID NO: 1773 - DNA, 20 bp, Artificial sequence
  Synthetic oligonucleotide
atgacttctcaaggtccaaa

SEQ ID NO: 1774 - DNA, 20 bp, Artificial sequence
  Synthetic oligonucleotide
gatgacttctcaaggtccaa

SEQ ID NO: 1775 - DNA, 20 bp, Artificial sequence
  Synthetic oligonucleotide
agatgacttctcaaggtcca

SEQ ID NO: 1776 - DNA, 20 bp, Artificial sequence
  Synthetic oligonucleotide
cagatgacttctcaaggtcc

SEQ ID NO: 1777 - DNA, 20 bp, Artificial sequence
  Synthetic oligonucleotide
tcagatgacttctcaaggtc

SEQ ID NO: 1778 - DNA, 20 bp, Artificial sequence
  Synthetic oligonucleotide
ttcagatgacttctcaaggt

SEQ ID NO: 1779 - DNA, 20 bp, Artificial sequence
  Synthetic oligonucleotide
attcagatgacttctcaagg

SEQ ID NO: 1780 - DNA, 20 bp, Artificial sequence
  Synthetic oligonucleotide
gattcagatgacttctcaag

SEQ ID NO: 1781 - DNA, 20 bp, Artificial sequence
  Synthetic oligonucleotide
tgattcagatgacttctcaa

SEQ ID NO: 1782 - DNA, 20 bp, Artificial sequence
  Synthetic oligonucleotide
gtgattcagatgacttctca

SEQ ID NO: 1783 - DNA, 20 bp, Artificial sequence
  Synthetic oligonucleotide
agtgattcagatgacttctc

SEQ ID NO: 1784 - DNA, 20 bp, Artificial sequence
  Synthetic oligonucleotide
tagtgattcagatgacttct

SEQ ID NO: 1785 - DNA, 20 bp, Artificial sequence
  Synthetic oligonucleotide
ctagtgattcagatgacttc

SEQ ID NO: 1786 - DNA, 20 bp, Artificial sequence
  Synthetic oligonucleotide
gctagtgattcagatgactt

SEQ ID NO: 1787 - DNA, 20 bp, Artificial sequence
  Synthetic oligonucleotide
ggctagtgattcagatgact

SEQ ID NO: 1788 - DNA, 20 bp, Artificial sequence
  Synthetic oligonucleotide
aggctagtgattcagatgac

SEQ ID NO: 1789 - DNA, 20 bp, Artificial sequence
  Synthetic oligonucleotide
gaggctagtgattcagatga

SEQ ID NO: 1790 - DNA, 20 bp, Artificial sequence
  Synthetic oligonucleotide
agaggctagtgattcagatg

SEQ ID NO: 1791 - DNA, 20 bp, Artificial sequence
  Synthetic oligonucleotide
tagaggctagtgattcagat

SEQ ID NO: 1792 - DNA, 20 bp, Artificial sequence
  Synthetic oligonucleotide
ttagaggctagtgattcaga

SEQ ID NO: 1793 - DNA, 20 bp, Artificial sequence
  Synthetic oligonucleotide
tttagaggctagtgattcag

SEQ ID NO: 1794 - DNA, 20 bp, Artificial sequence
  Synthetic oligonucleotide
atttagaggctagtgattca

SEQ ID NO: 1795 - DNA, 20 bp, Artificial sequence
  Synthetic oligonucleotide
aatttagaggctagtgattc

SEQ ID NO: 1796 - DNA, 20 bp, Artificial sequence
  Synthetic oligonucleotide
taatttagaggctagtgatt

SEQ ID NO: 1797 - DNA, 20 bp, Artificial sequence
  Synthetic oligonucleotide
ataatttagaggctagtgat

SEQ ID NO: 1798 - DNA, 20 bp, Artificial sequence
  Synthetic oligonucleotide
gataatttagaggctagtga

SEQ ID NO: 1799 - DNA, 20 bp, Artificial sequence
  Synthetic oligonucleotide
ggataatttagaggctagtg

SEQ ID NO: 1800 - DNA, 20 bp, Artificial sequence
  Synthetic oligonucleotide
tggataatttagaggctagt

SEQ ID NO: 1801 - DNA, 20 bp, Artificial sequence
  Synthetic oligonucleotide
ctggataatttagaggctag

SEQ ID NO: 1802 - DNA, 20 bp, Artificial sequence
  Synthetic oligonucleotide
tctggataatttagaggcta

SEQ ID NO: 1803 - DNA, 20 bp, Artificial sequence
  Synthetic oligonucleotide
gtctggataatttagaggct

SEQ ID NO: 1804 - DNA, 20 bp, Artificial sequence
  Synthetic oligonucleotide
agtctggataatttagaggc

SEQ ID NO: 1805 - DNA, 20 bp, Artificial sequence
  Synthetic oligonucleotide
cagtctggataatttagagg

SEQ ID NO: 1806 - DNA, 20 bp, Artificial sequence
  Synthetic oligonucleotide
tcagtctggataatttagag

SEQ ID NO: 1807 - DNA, 20 bp, Artificial sequence
  Synthetic oligonucleotide
ttcagtctggataatttaga

SEQ ID NO: 1808 - DNA, 20 bp, Artificial sequence
  Synthetic oligonucleotide
cttcagtctggataatttag

SEQ ID NO: 1809 - DNA, 20 bp, Artificial sequence
  Synthetic oligonucleotide
ccttcagtctggataattta

SEQ ID NO: 1810 - DNA, 20 bp, Artificial sequence
  Synthetic oligonucleotide
cccttcagtctggataattt

SEQ ID NO: 1811 - DNA, 20 bp, Artificial sequence
  Synthetic oligonucleotide
acccttcagtctggataatt

SEQ ID NO: 1812 - DNA, 20 bp, Artificial sequence
  Synthetic oligonucleotide
aacccttcagtctggataat

SEQ ID NO: 1813 - DNA, 20 bp, Artificial sequence
  Synthetic oligonucleotide
gaacccttcagtctggataa

SEQ ID NO: 1814 - DNA, 20 bp, Artificial sequence
  Synthetic oligonucleotide
ggaacccttcagtctggata

SEQ ID NO: 1815 - DNA, 20 bp, Artificial sequence
  Synthetic oligonucleotide
cggaacccttcagtctggat

SEQ ID NO: 1816 - DNA, 20 bp, Artificial sequence
  Synthetic oligonucleotide
tcggaacccttcagtctgga

SEQ ID NO: 1817 - DNA, 20 bp, Artificial sequence
  Synthetic oligonucleotide
ttcggaacccttcagtctgg

SEQ ID NO: 1818 - DNA, 20 bp, Artificial sequence
  Synthetic oligonucleotide
tttcggaacccttcagtctg

SEQ ID NO: 1819 - DNA, 20 bp, Artificial sequence
  Synthetic oligonucleotide
ctttcggaacccttcagtct

SEQ ID NO: 1820 - DNA, 20 bp, Artificial sequence
  Synthetic oligonucleotide
tctttcggaacccttcagtc

SEQ ID NO: 1821 - DNA, 20 bp, Artificial sequence
  Synthetic oligonucleotide
ctctttcggaacccttcagt

SEQ ID NO: 1822 - DNA, 20 bp, Artificial sequence
  Synthetic oligonucleotide
tctctttcggaacccttcag

SEQ ID NO: 1823 - DNA, 20 bp, Artificial sequence
  Synthetic oligonucleotide
ttctctttcggaacccttca

SEQ ID NO: 1824 - DNA, 20 bp, Artificial sequence
  Synthetic oligonucleotide
tttctctttcggaacccttc

SEQ ID NO: 1825 - DNA, 20 bp, Artificial sequence
  Synthetic oligonucleotide
gtttctctttcggaaccctt

SEQ ID NO: 1826 - DNA, 20 bp, Artificial sequence
  Synthetic oligonucleotide
agtttctctttcggaaccct

SEQ ID NO: 1827 - DNA, 20 bp, Artificial sequence
  Synthetic oligonucleotide
gagtttctctttcggaaccc

SEQ ID NO: 1828 - DNA, 20 bp, Artificial sequence
  Synthetic oligonucleotide
tgagtttctctttcggaacc

SEQ ID NO: 1829 - DNA, 20 bp, Artificial sequence
  Synthetic oligonucleotide
ttgagtttctctttcggaac

SEQ ID NO: 1830 - DNA, 20 bp, Artificial sequence
  Synthetic oligonucleotide
tttgagtttctctttcggaa

SEQ ID NO: 1831 - DNA, 20 bp, Artificial sequence
  Synthetic oligonucleotide
gtttgagtttctctttcgga

SEQ ID NO: 1832 - DNA, 20 bp, Artificial sequence
  Synthetic oligonucleotide
tgtttgagtttctctttcgg

SEQ ID NO: 1833 - DNA, 20 bp, Artificial sequence
  Synthetic oligonucleotide
ttgtttgagtttctctttcg

SEQ ID NO: 1834 - DNA, 20 bp, Artificial sequence
  Synthetic oligonucleotide
attgtttgagtttctctttc

SEQ ID NO: 1835 - DNA, 20 bp, Artificial sequence
  Synthetic oligonucleotide
cattgtttgagtttctcttt

SEQ ID NO: 1836 - DNA, 20 bp, Artificial sequence
  Synthetic oligonucleotide
ccattgtttgagtttctctt

SEQ ID NO: 1837 - DNA, 20 bp, Artificial sequence
  Synthetic oligonucleotide
cccattgtttgagtttctct

SEQ ID NO: 1838 - DNA, 20 bp, Artificial sequence
  Synthetic oligonucleotide
ccccattgtttgagtttctc

SEQ ID NO: 1839 - DNA, 20 bp, Artificial sequence
  Synthetic oligonucleotide
tccccattgtttgagtttct

SEQ ID NO: 1840 - DNA, 20 bp, Artificial sequence
  Synthetic oligonucleotide
atccccattgtttgagtttc

SEQ ID NO: 1841 - DNA, 20 bp, Artificial sequence
  Synthetic oligonucleotide
catccccattgtttgagttt

SEQ ID NO: 1842 - DNA, 20 bp, Artificial sequence
  Synthetic oligonucleotide
tcatccccattgtttgagtt

SEQ ID NO: 1843 - DNA, 20 bp, Artificial sequence
  Synthetic oligonucleotide
atcatccccattgtttgagt

SEQ ID NO: 1844 - DNA, 20 bp, Artificial sequence
  Synthetic oligonucleotide
catcatccccattgtttgag

SEQ ID NO: 1845 - DNA, 20 bp, Artificial sequence
  Synthetic oligonucleotide
tcatcatccccattgtttga

SEQ ID NO: 1846 - DNA, 20 bp, Artificial sequence
  Synthetic oligonucleotide
ctcatcatccccattgtttg

SEQ ID NO: 1847 - DNA, 20 bp, Artificial sequence
  Synthetic oligonucleotide
actcatcatccccattgttt

SEQ ID NO: 1848 - DNA, 20 bp, Artificial sequence
  Synthetic oligonucleotide
gactcatcatccccattgtt

SEQ ID NO: 1849 - DNA, 20 bp, Artificial sequence
  Synthetic oligonucleotide
cgactcatcatccccattgt

SEQ ID NO: 1850 - DNA, 20 bp, Artificial sequence
  Synthetic oligonucleotide
acgactcatcatccccattg

SEQ ID NO: 1851 - DNA, 20 bp, Artificial sequence
  Synthetic oligonucleotide
aacgactcatcatccccatt

SEQ ID NO: 1852 - DNA, 20 bp, Artificial sequence
  Synthetic oligonucleotide
aaacgactcatcatccccat

SEQ ID NO: 1853 - DNA, 20 bp, Artificial sequence
  Synthetic oligonucleotide
aaaacgactcatcatcccca

SEQ ID NO: 1854 - DNA, 20 bp, Artificial sequence
  Synthetic oligonucleotide
taaaacgactcatcatcccc

SEQ ID NO: 1855 - DNA, 20 bp, Artificial sequence
  Synthetic oligonucleotide
ttaaaacgactcatcatccc

SEQ ID NO: 1856 - DNA, 20 bp, Artificial sequence
  Synthetic oligonucleotide
attaaaacgactcatcatcc

SEQ ID NO: 1857 - DNA, 20 bp, Artificial sequence
  Synthetic oligonucleotide
cattaaaacgactcatcatc

SEQ ID NO: 1858 - DNA, 20 bp, Artificial sequence
  Synthetic oligonucleotide
tcattaaaacgactcatcat

SEQ ID NO: 1859 - DNA, 20 bp, Artificial sequence
  Synthetic oligonucleotide
ttcattaaaacgactcatca

SEQ ID NO: 1860 - DNA, 20 bp, Artificial sequence
  Synthetic oligonucleotide
gttcattaaaacgactcatc

SEQ ID NO: 1861 - DNA, 20 bp, Artificial sequence
  Synthetic oligonucleotide
agttcattaaaacgactcat

SEQ ID NO: 1862 - DNA, 20 bp, Artificial sequence
  Synthetic oligonucleotide
aagttcattaaaacgactca

SEQ ID NO: 1863 - DNA, 20 bp, Artificial sequence
  Synthetic oligonucleotide
gaagttcattaaaacgactc

SEQ ID NO: 1864 - DNA, 20 bp, Artificial sequence
  Synthetic oligonucleotide
ggaagttcattaaaacgact

SEQ ID NO: 1865 - DNA, 20 bp, Artificial sequence
  Synthetic oligonucleotide
tggaagttcattaaaacgac

SEQ ID NO: 1866 - DNA, 20 bp, Artificial sequence
  Synthetic oligonucleotide
ttggaagttcattaaaacga

SEQ ID NO: 1867 - DNA, 20 bp, Artificial sequence
  Synthetic oligonucleotide
tttggaagttcattaaaacg

SEQ ID NO: 1868 - DNA, 20 bp, Artificial sequence
  Synthetic oligonucleotide
atttggaagttcattaaaac

SEQ ID NO: 1869 - DNA, 20 bp, Artificial sequence
  Synthetic oligonucleotide
gaatttggaagttcattaaa

SEQ ID NO: 1870 - DNA, 20 bp, Artificial sequence
  Synthetic oligonucleotide
tgaatttggaagttcattaa

SEQ ID NO: 1871 - DNA, 20 bp, Artificial sequence
  Synthetic oligonucleotide
ctgaatttggaagttcatta

SEQ ID NO: 1872 - DNA, 20 bp, Artificial sequence
  Synthetic oligonucleotide
tctgaatttggaagttcatt

SEQ ID NO: 1873 - DNA, 20 bp, Artificial sequence
  Synthetic oligonucleotide
atctgaatttggaagttcat

SEQ ID NO: 1874 - DNA, 20 bp, Artificial sequence
  Synthetic oligonucleotide
aatctgaatttggaagttca

SEQ ID NO: 1875 - DNA, 20 bp, Artificial sequence
  Synthetic oligonucleotide
gaatctgaatttggaagttc

SEQ ID NO: 1876 - DNA, 20 bp, Artificial sequence
  Synthetic oligonucleotide
ggaatctgaatttggaagtt

SEQ ID NO: 1877 - DNA, 20 bp, Artificial sequence
  Synthetic oligonucleotide
tggaatctgaatttggaagt

SEQ ID NO: 1878 - DNA, 20 bp, Artificial sequence
  Synthetic oligonucleotide
ctggaatctgaatttggaag

SEQ ID NO: 1879 - DNA, 20 bp, Artificial sequence
  Synthetic oligonucleotide
actggaatctgaatttggaa

SEQ ID NO: 1880 - DNA, 20 bp, Artificial sequence
  Synthetic oligonucleotide
tactggaatctgaatttgga

SEQ ID NO: 1881 - DNA, 20 bp, Artificial sequence
  Synthetic oligonucleotide
ctactggaatctgaatttgg

SEQ ID NO: 1882 - DNA, 20 bp, Artificial sequence
  Synthetic oligonucleotide
cctactggaatctgaatttg

SEQ ID NO: 1883 - DNA, 20 bp, Artificial sequence
  Synthetic oligonucleotide
cttgctgtctttcctactgg

SEQ ID NO: 1884 - DNA, 20 bp, Artificial sequence
  Synthetic oligonucleotide
acttgctgtctttcctactg

SEQ ID NO: 1885 - DNA, 20 bp, Artificial sequence
  Synthetic oligonucleotide
aacttgctgtctttcctact

SEQ ID NO: 1886 - DNA, 20 bp, Artificial sequence
  Synthetic oligonucleotide
caacttgctgtctttcctac

SEQ ID NO: 1887 - DNA, 20 bp, Artificial sequence
  Synthetic oligonucleotide
acaacttgctgtctttccta

SEQ ID NO: 1888 - DNA, 20 bp, Artificial sequence
  Synthetic oligonucleotide
cacaacttgctgtctttcct

SEQ ID NO: 1889 - DNA, 20 bp, Artificial sequence
  Synthetic oligonucleotide
ttaacacactgcacaacttg

SEQ ID NO: 1890 - DNA, 20 bp, Artificial sequence
  Synthetic oligonucleotide
gttaacacactgcacaactt

SEQ ID NO: 1891 - DNA, 20 bp, Artificial sequence
  Synthetic oligonucleotide
tgttaacacactgcacaact

SEQ ID NO: 1892 - DNA, 20 bp, Artificial sequence
  Synthetic oligonucleotide
acaaaaatcttgtgttaaca

SEQ ID NO: 1893 - DNA, 20 bp, Artificial sequence
  Synthetic oligonucleotide
tacaaaaatcttgtgttaac

SEQ ID NO: 1894 - DNA, 20 bp, Artificial sequence
  Synthetic oligonucleotide
catacaaaaatcttgtgtta

SEQ ID NO: 1895 - DNA, 20 bp, Artificial sequence
  Synthetic oligonucleotide
acatacaaaaatcttgtgtt

SEQ ID NO: 1896 - DNA, 20 bp, Artificial sequence
  Synthetic oligonucleotide
aacatacaaaaatcttgtgt

SEQ ID NO: 1897 - DNA, 20 bp, Artificial sequence
  Synthetic oligonucleotide
taacatacaaaaatcttgtg

SEQ ID NO: 1898 - DNA, 20 bp, Artificial sequence
  Synthetic oligonucleotide
tcatgcttgttgttaaataa

SEQ ID NO: 1899 - DNA, 20 bp, Artificial sequence
  Synthetic oligonucleotide
ttcatgcttgttgttaaata

SEQ ID NO: 1900 - DNA, 20 bp, Artificial sequence
  Synthetic oligonucleotide
tttcatgcttgttgttaaat

SEQ ID NO: 1901 - DNA, 20 bp, Artificial sequence
  Synthetic oligonucleotide
ttttcatgcttgttgttaaa

SEQ ID NO: 1902 - DNA, 20 bp, Artificial sequence
  Synthetic oligonucleotide
tttttcatgcttgttgttaa

SEQ ID NO: 1903 - DNA, 20 bp, Artificial sequence
  Synthetic oligonucleotide
tgacaccattctctgttttt

SEQ ID NO: 1904 - DNA, 20 bp, Artificial sequence
  Synthetic oligonucleotide
atgacaccattctctgtttt

SEQ ID NO: 1905 - DNA, 20 bp, Artificial sequence
  Synthetic oligonucleotide
gatgacaccattctctgttt

SEQ ID NO: 1906 - DNA, 20 bp, Artificial sequence
  Synthetic oligonucleotide
ggatgacaccattctctgtt

SEQ ID NO: 1907 - DNA, 20 bp, Artificial sequence
  Synthetic oligonucleotide
gggatgacaccattctctgt

SEQ ID NO: 1908 - DNA, 20 bp, Artificial sequence
  Synthetic oligonucleotide
tgggatgacaccattctctg

SEQ ID NO: 1909 - DNA, 20 bp, Artificial sequence
  Synthetic oligonucleotide
ttgggatgacaccattctct

SEQ ID NO: 1910 - DNA, 20 bp, Artificial sequence
  Synthetic oligonucleotide
gttgggatgacaccattctc

SEQ ID NO: 1911 - DNA, 20 bp, Artificial sequence
  Synthetic oligonucleotide
tgttgggatgacaccattct

SEQ ID NO: 1912 - DNA, 20 bp, Artificial sequence
  Synthetic oligonucleotide
atgttgggatgacaccattc

SEQ ID NO: 1913 - DNA, 20 bp, Artificial sequence
  Synthetic oligonucleotide
gatgttgggatgacaccatt

SEQ ID NO: 1914 - DNA, 20 bp, Artificial sequence
  Synthetic oligonucleotide
tgatgttgggatgacaccat

SEQ ID NO: 1915 - DNA, 20 bp, Artificial sequence
  Synthetic oligonucleotide
ctgatgttgggatgacacca

SEQ ID NO: 1916 - DNA, 20 bp, Artificial sequence
  Synthetic oligonucleotide
tctgatgttgggatgacacc

SEQ ID NO: 1917 - DNA, 20 bp, Artificial sequence
  Synthetic oligonucleotide
atctgatgttgggatgacac

SEQ ID NO: 1918 - DNA, 20 bp, Artificial sequence
  Synthetic oligonucleotide
aatctgatgttgggatgaca

SEQ ID NO: 1919 - DNA, 20 bp, Artificial sequence
  Synthetic oligonucleotide
gaatctgatgttgggatgac

SEQ ID NO: 1920 - DNA, 20 bp, Artificial sequence
  Synthetic oligonucleotide
agaatctgatgttgggatga

SEQ ID NO: 1921 - DNA, 20 bp, Artificial sequence
  Synthetic oligonucleotide
cagaatctgatgttgggatg

SEQ ID NO: 1922 - DNA, 20 bp, Artificial sequence
  Synthetic oligonucleotide
gcagaatctgatgttgggat

SEQ ID NO: 1923 - DNA, 20 bp, Artificial sequence
  Synthetic oligonucleotide
ggcagaatctgatgttggga

SEQ ID NO: 1924 - DNA, 20 bp, Artificial sequence
  Synthetic oligonucleotide
tggcagaatctgatgttggg

SEQ ID NO: 1925 - DNA, 20 bp, Artificial sequence
  Synthetic oligonucleotide
gtggcagaatctgatgttgg

SEQ ID NO: 1926 - DNA, 20 bp, Artificial sequence
  Synthetic oligonucleotide
tgtggcagaatctgatgttg

SEQ ID NO: 1927 - DNA, 20 bp, Artificial sequence
  Synthetic oligonucleotide
gtgtggcagaatctgatgtt

SEQ ID NO: 1928 - DNA, 20 bp, Artificial sequence
  Synthetic oligonucleotide
tgtgtggcagaatctgatgt

SEQ ID NO: 1929 - DNA, 20 bp, Artificial sequence
  Synthetic oligonucleotide
gttagaatgtgttttactat

SEQ ID NO: 1930 - DNA, 20 bp, Artificial sequence
  Synthetic oligonucleotide
tgttagaatgtgttttacta

SEQ ID NO: 1931 - DNA, 20 bp, Artificial sequence
  Synthetic oligonucleotide
ctgttagaatgtgttttact

SEQ ID NO: 1932 - DNA, 20 bp, Artificial sequence
  Synthetic oligonucleotide
gctgttagaatgtgttttac

SEQ ID NO: 1933 - DNA, 20 bp, Artificial sequence
  Synthetic oligonucleotide
tgctgttagaatgtgtttta

SEQ ID NO: 1934 - DNA, 20 bp, Artificial sequence
  Synthetic oligonucleotide
ttgctgttagaatgtgtttt

SEQ ID NO: 1935 - DNA, 20 bp, Artificial sequence
  Synthetic oligonucleotide
attgctgttagaatgtgttt

SEQ ID NO: 1936 - DNA, 20 bp, Artificial sequence
  Synthetic oligonucleotide
tattgctgttagaatgtgtt

SEQ ID NO: 1937 - DNA, 20 bp, Artificial sequence
  Synthetic oligonucleotide
gtattgctgttagaatgtgt

SEQ ID NO: 1938 - DNA, 20 bp, Artificial sequence
  Synthetic oligonucleotide
tgtattgctgttagaatgtg

SEQ ID NO: 1939 - DNA, 20 bp, Artificial sequence
  Synthetic oligonucleotide
ttgtattgctgttagaatgt

SEQ ID NO: 1940 - DNA, 20 bp, Artificial sequence
  Synthetic oligonucleotide
gttgtattgctgttagaatg

SEQ ID NO: 1941 - DNA, 20 bp, Artificial sequence
  Synthetic oligonucleotide
tgttgtattgctgttagaat

SEQ ID NO: 1942 - DNA, 20 bp, Artificial sequence
  Synthetic oligonucleotide
ctgttgtattgctgttagaa

SEQ ID NO: 1943 - DNA, 20 bp, Artificial sequence
  Synthetic oligonucleotide
tctgttgtattgctgttaga

SEQ ID NO: 1944 - DNA, 20 bp, Artificial sequence
  Synthetic oligonucleotide
ctctgttgtattgctgttag

SEQ ID NO: 1945 - DNA, 20 bp, Artificial sequence
  Synthetic oligonucleotide
tctctgttgtattgctgtta

SEQ ID NO: 1946 - DNA, 20 bp, Artificial sequence
  Synthetic oligonucleotide
ttctctgttgtattgctgtt

SEQ ID NO: 1947 - DNA, 20 bp, Artificial sequence
  Synthetic oligonucleotide
gttctctgttgtattgctgt

SEQ ID NO: 1948 - DNA, 20 bp, Artificial sequence
  Synthetic oligonucleotide
agttctctgttgtattgctg

SEQ ID NO: 1949 - DNA, 20 bp, Artificial sequence
  Synthetic oligonucleotide
cagttctctgttgtattgct

SEQ ID NO: 1950 - DNA, 20 bp, Artificial sequence
  Synthetic oligonucleotide
ctgatatcacacagttctct

SEQ ID NO: 1951 - DNA, 20 bp, Artificial sequence
  Synthetic oligonucleotide
tctgatatcacacagttctc

SEQ ID NO: 1952 - DNA, 20 bp, Artificial sequence
  Synthetic oligonucleotide
ttctgatatcacacagttct

SEQ ID NO: 1953 - DNA, 20 bp, Artificial sequence
  Synthetic oligonucleotide
tttctgatatcacacagttc

SEQ ID NO: 1954 - DNA, 20 bp, Artificial sequence
  Synthetic oligonucleotide
gtttctgatatcacacagtt

SEQ ID NO: 1955 - DNA, 20 bp, Artificial sequence
  Synthetic oligonucleotide
agtttctgatatcacacagt

SEQ ID NO: 1956 - DNA, 20 bp, Artificial sequence
  Synthetic oligonucleotide
gagtttctgatatcacacag

SEQ ID NO: 1957 - DNA, 20 bp, Artificial sequence
  Synthetic oligonucleotide
ggagtttctgatatcacaca

SEQ ID NO: 1958 - DNA, 20 bp, Artificial sequence
  Synthetic oligonucleotide
aggagtttctgatatcacac

SEQ ID NO: 1959 - DNA, 20 bp, Artificial sequence
  Synthetic oligonucleotide
aaggagtttctgatatcaca

SEQ ID NO: 1960 - DNA, 20 bp, Artificial sequence
  Synthetic oligonucleotide
aaaggagtttctgatatcac

SEQ ID NO: 1961 - DNA, 20 bp, Artificial sequence
  Synthetic oligonucleotide
caaaggagtttctgatatca

SEQ ID NO: 1962 - DNA, 20 bp, Artificial sequence
  Synthetic oligonucleotide
ccaaaggagtttctgatatc

SEQ ID NO: 1963 - DNA, 20 bp, Artificial sequence
  Synthetic oligonucleotide
accaaaggagtttctgatat

SEQ ID NO: 1964 - DNA, 20 bp, Artificial sequence
  Synthetic oligonucleotide
taccaaaggagtttctgata

SEQ ID NO: 1965 - DNA, 20 bp, Artificial sequence
  Synthetic oligonucleotide
ataccaaaggagtttctgat

SEQ ID NO: 1966 - DNA, 20 bp, Artificial sequence
  Synthetic oligonucleotide
aataccaaaggagtttctga

SEQ ID NO: 1967 - DNA, 20 bp, Artificial sequence
  Synthetic oligonucleotide
caataccaaaggagtttctg

SEQ ID NO: 1968 - DNA, 20 bp, Artificial sequence
  Synthetic oligonucleotide
gcaataccaaaggagtttct

SEQ ID NO: 1969 - DNA, 20 bp, Artificial sequence
  Synthetic oligonucleotide
gaattattatagggcaatac

SEQ ID NO: 1970 - DNA, 20 bp, Artificial sequence
  Synthetic oligonucleotide
agaattattatagggcaata

SEQ ID NO: 1971 - DNA, 20 bp, Artificial sequence
  Synthetic oligonucleotide
tagaattattatagggcaat

SEQ ID NO: 1972 - DNA, 20 bp, Artificial sequence
  Synthetic oligonucleotide
ttagaattattatagggcaa

SEQ ID NO: 1973 - DNA, 20 bp, Artificial sequence
  Synthetic oligonucleotide
tttagaattattatagggca

SEQ ID NO: 1974 - DNA, 20 bp, Artificial sequence
  Synthetic oligonucleotide
ctttagaattattatagggc

SEQ ID NO: 1975 - DNA, 20 bp, Artificial sequence
  Synthetic oligonucleotide
actttagaattattataggg

SEQ ID NO: 1976 - DNA, 20 bp, Artificial sequence
  Synthetic oligonucleotide
cggtaactttagaattatta

SEQ ID NO: 1977 - DNA, 20 bp, Artificial sequence
  Synthetic oligonucleotide
ccggtaactttagaattatt

SEQ ID NO: 1978 - DNA, 20 bp, Artificial sequence
  Synthetic oligonucleotide
accggtaactttagaattat

SEQ ID NO: 1979 - DNA, 20 bp, Artificial sequence
  Synthetic oligonucleotide
taccggtaactttagaatta

SEQ ID NO: 1980 - DNA, 20 bp, Artificial sequence
  Synthetic oligonucleotide
ttaccggtaactttagaatt

SEQ ID NO: 1981 - DNA, 20 bp, Artificial sequence
  Synthetic oligonucleotide
tttaccggtaactttagaat

SEQ ID NO: 1982 - DNA, 20 bp, Artificial sequence
  Synthetic oligonucleotide
ctttaccggtaactttagaa

SEQ ID NO: 1983 - DNA, 20 bp, Artificial sequence
  Synthetic oligonucleotide
tctttaccggtaactttaga

SEQ ID NO: 1984 - DNA, 20 bp, Artificial sequence
  Synthetic oligonucleotide
atctttaccggtaactttag

SEQ ID NO: 1985 - DNA, 20 bp, Artificial sequence
  Synthetic oligonucleotide
aatctttaccggtaacttta

SEQ ID NO: 1986 - DNA, 20 bp, Artificial sequence
  Synthetic oligonucleotide
gaatctttaccggtaacttt

SEQ ID NO: 1987 - DNA, 20 bp, Artificial sequence
  Synthetic oligonucleotide
tgaatctttaccggtaactt

SEQ ID NO: 1988 - DNA, 20 bp, Artificial sequence
  Synthetic oligonucleotide
ctgaatctttaccggtaact

SEQ ID NO: 1989 - DNA, 20 bp, Artificial sequence
  Synthetic oligonucleotide
tctgaatctttaccggtaac

SEQ ID NO: 1990 - DNA, 20 bp, Artificial sequence
  Synthetic oligonucleotide
atctgaatctttaccggtaa

SEQ ID NO: 1991 - DNA, 20 bp, Artificial sequence
  Synthetic oligonucleotide
catctgaatctttaccggta

SEQ ID NO: 1992 - DNA, 20 bp, Artificial sequence
  Synthetic oligonucleotide
acatctgaatctttaccggt

SEQ ID NO: 1993 - DNA, 20 bp, Artificial sequence
  Synthetic oligonucleotide
aacatctgaatctttaccgg

SEQ ID NO: 1994 - DNA, 20 bp, Artificial sequence
  Synthetic oligonucleotide
gaacatctgaatctttaccg

SEQ ID NO: 1995 - DNA, 20 bp, Artificial sequence
  Synthetic oligonucleotide
agaacatctgaatctttacc

SEQ ID NO: 1996 - DNA, 20 bp, Artificial sequence
  Synthetic oligonucleotide
aagaacatctgaatctttac

SEQ ID NO: 1997 - DNA, 20 bp, Artificial sequence
  Synthetic oligonucleotide
taagaacatctgaatcttta

SEQ ID NO: 1998 - DNA, 20 bp, Artificial sequence
  Synthetic oligonucleotide
ataagaacatctgaatcttt

SEQ ID NO: 1999 - DNA, 20 bp, Artificial sequence
  Synthetic oligonucleotide
gataagaacatctgaatctt

SEQ ID NO: 2000 - DNA, 20 bp, Artificial sequence
  Synthetic oligonucleotide
tgataagaacatctgaatct

SEQ ID NO: 2001 - DNA, 20 bp, Artificial sequence
  Synthetic oligonucleotide
ctgataagaacatctgaatc

SEQ ID NO: 2002 - DNA, 20 bp, Artificial sequence
  Synthetic oligonucleotide
tctgataagaacatctgaat

SEQ ID NO: 2003 - DNA, 20 bp, Artificial sequence
  Synthetic oligonucleotide
ctctgataagaacatctgaa

SEQ ID NO: 2004 - DNA, 20 bp, Artificial sequence
  Synthetic oligonucleotide
gctctgataagaacatctga

SEQ ID NO: 2005 - DNA, 20 bp, Artificial sequence
  Synthetic oligonucleotide
ggctctgataagaacatctg

SEQ ID NO: 2006 - DNA, 20 bp, Artificial sequence
  Synthetic oligonucleotide
aggctctgataagaacatct

SEQ ID NO: 2007 - DNA, 20 bp, Artificial sequence
  Synthetic oligonucleotide
gaggctctgataagaacatc

SEQ ID NO: 2008 - DNA, 20 bp, Artificial sequence
  Synthetic oligonucleotide
tgaggctctgataagaacat

SEQ ID NO: 2009 - DNA, 20 bp, Artificial sequence
  Synthetic oligonucleotide
ctgaggctctgataagaaca

SEQ ID NO: 2010 - DNA, 20 bp, Artificial sequence
  Synthetic oligonucleotide
tctgaggctctgataagaac

SEQ ID NO: 2011 - DNA, 20 bp, Artificial sequence
  Synthetic oligonucleotide
ttctgaggctctgataagaa

SEQ ID NO: 2012 - DNA, 20 bp, Artificial sequence
  Synthetic oligonucleotide
gttctgaggctctgataaga

SEQ ID NO: 2013 - DNA, 20 bp, Artificial sequence
  Synthetic oligonucleotide
tgttctgaggctctgataag

SEQ ID NO: 2014 - DNA, 20 bp, Artificial sequence
  Synthetic oligonucleotide
ttgttctgaggctctgataa

SEQ ID NO: 2015 - DNA, 20 bp, Artificial sequence
  Synthetic oligonucleotide
gttgttctgaggctctgata

SEQ ID NO: 2016 - DNA, 20 bp, Artificial sequence
  Synthetic oligonucleotide
tgttgttctgaggctctgat

SEQ ID NO: 2017 - DNA, 20 bp, Artificial sequence
  Synthetic oligonucleotide
ctgttgttctgaggctctga

SEQ ID NO: 2018 - DNA, 20 bp, Artificial sequence
  Synthetic oligonucleotide
tctgttgttctgaggctctg

SEQ ID NO: 2019 - DNA, 20 bp, Artificial sequence
  Synthetic oligonucleotide
atctgttgttctgaggctct

SEQ ID NO: 2020 - DNA, 20 bp, Artificial sequence
  Synthetic oligonucleotide
tatctgttgttctgaggctc

SEQ ID NO: 2021 - DNA, 20 bp, Artificial sequence
  Synthetic oligonucleotide
ctatctgttgttctgaggct

SEQ ID NO: 2022 - DNA, 20 bp, Artificial sequence
  Synthetic oligonucleotide
cctatctgttgttctgaggc

SEQ ID NO: 2023 - DNA, 20 bp, Artificial sequence
  Synthetic oligonucleotide
tcctatctgttgttctgagg

SEQ ID NO: 2024 - DNA, 20 bp, Artificial sequence
  Synthetic oligonucleotide
ttcctatctgttgttctgag

SEQ ID NO: 2025 - DNA, 20 bp, Artificial sequence
  Synthetic oligonucleotide
cttcctatctgttgttctga

SEQ ID NO: 2026 - DNA, 20 bp, Artificial sequence
  Synthetic oligonucleotide
acttcctatctgttgttctg

SEQ ID NO: 2027 - DNA, 20 bp, Artificial sequence
  Synthetic oligonucleotide
gacttcctatctgttgttct

SEQ ID NO: 2028 - DNA, 20 bp, Artificial sequence
  Synthetic oligonucleotide
agacttcctatctgttgttc

SEQ ID NO: 2029 - DNA, 20 bp, Artificial sequence
  Synthetic oligonucleotide
aagacttcctatctgttgtt

SEQ ID NO: 2030 - DNA, 20 bp, Artificial sequence
  Synthetic oligonucleotide
caagacttcctatctgttgt

SEQ ID NO: 2031 - DNA, 20 bp, Artificial sequence
  Synthetic oligonucleotide
tcaagacttcctatctgttg

SEQ ID NO: 2032 - DNA, 20 bp, Artificial sequence
  Synthetic oligonucleotide
gtcaagacttcctatctgtt

SEQ ID NO: 2033 - DNA, 20 bp, Artificial sequence
  Synthetic oligonucleotide
agtcaagacttcctatctgt

SEQ ID NO: 2034 - DNA, 20 bp, Artificial sequence
  Synthetic oligonucleotide
tccactgggagagtcaagac

SEQ ID NO: 2035 - DNA, 20 bp, Artificial sequence
  Synthetic oligonucleotide
ttcattaacattccactggg

SEQ ID NO: 2036 - DNA, 20 bp, Artificial sequence
  Synthetic oligonucleotide
attcattaacattccactgg

SEQ ID NO: 2037 - DNA, 20 bp, Artificial sequence
  Synthetic oligonucleotide
gattcattaacattccactg

SEQ ID NO: 2038 - DNA, 20 bp, Artificial sequence
  Synthetic oligonucleotide
ggattcattaacattccact

SEQ ID NO: 2039 - DNA, 20 bp, Artificial sequence
  Synthetic oligonucleotide
cggattcattaacattccac

SEQ ID NO: 2040 - DNA, 20 bp, Artificial sequence
  Synthetic oligonucleotide
ccggattcattaacattcca

SEQ ID NO: 2041 - DNA, 20 bp, Artificial sequence
  Synthetic oligonucleotide
accggattcattaacattcc

SEQ ID NO: 2042 - DNA, 20 bp, Artificial sequence
  Synthetic oligonucleotide
taccggattcattaacattc

SEQ ID NO: 2043 - DNA, 20 bp, Artificial sequence
  Synthetic oligonucleotide
ctaccggattcattaacatt

SEQ ID NO: 2044 - DNA, 20 bp, Artificial sequence
  Synthetic oligonucleotide
tctaccggattcattaacat

SEQ ID NO: 2045 - DNA, 20 bp, Artificial sequence
  Synthetic oligonucleotide
ttctaccggattcattaaca

SEQ ID NO: 2046 - DNA, 20 bp, Artificial sequence
  Synthetic oligonucleotide
cttctaccggattcattaac

SEQ ID NO: 2047 - DNA, 20 bp, Artificial sequence
  Synthetic oligonucleotide
tcttctaccggattcattaa

SEQ ID NO: 2048 - DNA, 20 bp, Artificial sequence
  Synthetic oligonucleotide
atcttctaccggattcatta

SEQ ID NO: 2049 - DNA, 20 bp, Artificial sequence
  Synthetic oligonucleotide
catcttctaccggattcatt

SEQ ID NO: 2050 - DNA, 20 bp, Artificial sequence
  Synthetic oligonucleotide
gcatcttctaccggattcat

SEQ ID NO: 2051 - DNA, 20 bp, Artificial sequence
  Synthetic oligonucleotide
ggcatcttctaccggattca

SEQ ID NO: 2052 - DNA, 20 bp, Artificial sequence
  Synthetic oligonucleotide
tggcatcttctaccggattc

SEQ ID NO: 2053 - DNA, 20 bp, Artificial sequence
  Synthetic oligonucleotide
gtggcatcttctaccggatt

SEQ ID NO: 2054 - DNA, 20 bp, Artificial sequence
  Synthetic oligonucleotide
tgtggcatcttctaccggat

SEQ ID NO: 2055 - DNA, 20 bp, Artificial sequence
  Synthetic oligonucleotide
ctgtggcatcttctaccgga

SEQ ID NO: 2056 - DNA, 20 bp, Artificial sequence
  Synthetic oligonucleotide
acctgtggcatcttctaccg

SEQ ID NO: 2057 - DNA, 20 bp, Artificial sequence
  Synthetic oligonucleotide
cacctgtggcatcttctacc

SEQ ID NO: 2058 - DNA, 20 bp, Artificial sequence
  Synthetic oligonucleotide
tcacctgtggcatcttctac

SEQ ID NO: 2059 - DNA, 20 bp, Artificial sequence
  Synthetic oligonucleotide
gtcacctgtggcatcttcta

SEQ ID NO: 2060 - DNA, 20 bp, Artificial sequence
  Synthetic oligonucleotide
ggtcacctgtggcatcttct

SEQ ID NO: 2061 - DNA, 20 bp, Artificial sequence
  Synthetic oligonucleotide
tggtcacctgtggcatcttc

SEQ ID NO: 2062 - DNA, 20 bp, Artificial sequence
  Synthetic oligonucleotide
ttggtcacctgtggcatctt

SEQ ID NO: 2063 - DNA, 20 bp, Artificial sequence
  Synthetic oligonucleotide
tttggtcacctgtggcatct

SEQ ID NO: 2064 - DNA, 20 bp, Artificial sequence
  Synthetic oligonucleotide
ttttggtcacctgtggcatc

SEQ ID NO: 2065 - DNA, 20 bp, Artificial sequence
  Synthetic oligonucleotide
attttggtcacctgtggcat

SEQ ID NO: 2066 - DNA, 20 bp, Artificial sequence
  Synthetic oligonucleotide
cattttggtcacctgtggca

SEQ ID NO: 2067 - DNA, 20 bp, Artificial sequence
  Synthetic oligonucleotide
ccattttggtcacctgtggc

SEQ ID NO: 2068 - DNA, 20 bp, Artificial sequence
  Synthetic oligonucleotide
ctgaaaacaaattccatttt

SEQ ID NO: 2069 - DNA, 20 bp, Artificial sequence
  Synthetic oligonucleotide
tctgaaaacaaattccattt

SEQ ID NO: 2070 - DNA, 20 bp, Artificial sequence
  Synthetic oligonucleotide
ctctgaaaacaaattccatt

SEQ ID NO: 2071 - DNA, 20 bp, Artificial sequence
  Synthetic oligonucleotide
actctgaaaacaaattccat

SEQ ID NO: 2072 - DNA, 20 bp, Artificial sequence
  Synthetic oligonucleotide
cactctgaaaacaaattcca

SEQ ID NO: 2073 - DNA, 20 bp, Artificial sequence
  Synthetic oligonucleotide
tcactctgaaaacaaattcc

SEQ ID NO: 2074 - DNA, 20 bp, Artificial sequence
  Synthetic oligonucleotide
ctcactctgaaaacaaattc

SEQ ID NO: 2075 - DNA, 20 bp, Artificial sequence
  Synthetic oligonucleotide
cctcactctgaaaacaaatt

SEQ ID NO: 2076 - DNA, 20 bp, Artificial sequence
  Synthetic oligonucleotide
tcctcactctgaaaacaaat

SEQ ID NO: 2077 - DNA, 20 bp, Artificial sequence
  Synthetic oligonucleotide
ttcctcactctgaaaacaaa

SEQ ID NO: 2078 - DNA, 20 bp, Artificial sequence
  Synthetic oligonucleotide
attcctcactctgaaaacaa

SEQ ID NO: 2079 - DNA, 20 bp, Artificial sequence
  Synthetic oligonucleotide
gattcctcactctgaaaaca

SEQ ID NO: 2080 - DNA, 20 bp, Artificial sequence
  Synthetic oligonucleotide
agattcctcactctgaaaac

SEQ ID NO: 2081 - DNA, 20 bp, Artificial sequence
  Synthetic oligonucleotide
tagattcctcactctgaaaa

SEQ ID NO: 2082 - DNA, 20 bp, Artificial sequence
  Synthetic oligonucleotide
ttagattcctcactctgaaa

SEQ ID NO: 2083 - DNA, 20 bp, Artificial sequence
  Synthetic oligonucleotide
tttagattcctcactctgaa

SEQ ID NO: 2084 - DNA, 20 bp, Artificial sequence
  Synthetic oligonucleotide
ctttagattcctcactctga

SEQ ID NO: 2085 - DNA, 20 bp, Artificial sequence
  Synthetic oligonucleotide
gctttagattcctcactctg

SEQ ID NO: 2086 - DNA, 20 bp, Artificial sequence
  Synthetic oligonucleotide
tgctttagattcctcactct

SEQ ID NO: 2087 - DNA, 20 bp, Artificial sequence
  Synthetic oligonucleotide
ttgctttagattcctcactc

SEQ ID NO: 2088 - DNA, 20 bp, Artificial sequence
  Synthetic oligonucleotide
cttgctttagattcctcact

SEQ ID NO: 2089 - DNA, 20 bp, Artificial sequence
  Synthetic oligonucleotide
tcttgctttagattcctcac

SEQ ID NO: 2090 - DNA, 20 bp, Artificial sequence
  Synthetic oligonucleotide
ctcttgctttagattcctca

SEQ ID NO: 2091 - DNA, 20 bp, Artificial sequence
  Synthetic oligonucleotide
gctcttgctttagattcctc

SEQ ID NO: 2092 - DNA, 20 bp, Artificial sequence
  Synthetic oligonucleotide
cagtttcagaacaagctctt

SEQ ID NO: 2093 - DNA, 20 bp, Artificial sequence
  Synthetic oligonucleotide
tcagtttcagaacaagctct

SEQ ID NO: 2094 - DNA, 20 bp, Artificial sequence
  Synthetic oligonucleotide
ttcagtttcagaacaagctc

SEQ ID NO: 2095 - DNA, 20 bp, Artificial sequence
  Synthetic oligonucleotide
cttcagtttcagaacaagct

SEQ ID NO: 2096 - DNA, 20 bp, Artificial sequence
  Synthetic oligonucleotide
tcttcagtttcagaacaagc

SEQ ID NO: 2097 - DNA, 20 bp, Artificial sequence
  Synthetic oligonucleotide
ctcttcagtttcagaacaag

SEQ ID NO: 2098 - DNA, 20 bp, Artificial sequence
  Synthetic oligonucleotide
actcttcagtttcagaacaa

SEQ ID NO: 2099 - DNA, 20 bp, Artificial sequence
  Synthetic oligonucleotide
gactcttcagtttcagaaca

SEQ ID NO: 2100 - DNA, 20 bp, Artificial sequence
  Synthetic oligonucleotide
tgactcttcagtttcagaac

SEQ ID NO: 2101 - DNA, 20 bp, Artificial sequence
  Synthetic oligonucleotide
ttgactcttcagtttcagaa

SEQ ID NO: 2102 - DNA, 20 bp, Artificial sequence
  Synthetic oligonucleotide
tttgactcttcagtttcaga

SEQ ID NO: 2103 - DNA, 20 bp, Artificial sequence
  Synthetic oligonucleotide
gtttgactcttcagtttcag

SEQ ID NO: 2104 - DNA, 20 bp, Artificial sequence
  Synthetic oligonucleotide
tgtttgactcttcagtttca

SEQ ID NO: 2105 - DNA, 20 bp, Artificial sequence
  Synthetic oligonucleotide
gtgtttgactcttcagtttc

SEQ ID NO: 2106 - DNA, 20 bp, Artificial sequence
  Synthetic oligonucleotide
cgtgtttgactcttcagttt

SEQ ID NO: 2107 - DNA, 20 bp, Artificial sequence
  Synthetic oligonucleotide
acgtgtttgactcttcagtt

SEQ ID NO: 2108 - DNA, 20 bp, Artificial sequence
  Synthetic oligonucleotide
cacgtgtttgactcttcagt

SEQ ID NO: 2109 - DNA, 20 bp, Artificial sequence
  Synthetic oligonucleotide
acacgtgtttgactcttcag

SEQ ID NO: 2110 - DNA, 20 bp, Artificial sequence
  Synthetic oligonucleotide
aacacgtgtttgactcttca

SEQ ID NO: 2111 - DNA, 20 bp, Artificial sequence
  Synthetic oligonucleotide
gccaatctgaacaacacgtg

SEQ ID NO: 2112 - DNA, 20 bp, Artificial sequence
  Synthetic oligonucleotide
tgccaatctgaacaacacgt

SEQ ID NO: 2113 - DNA, 20 bp, Artificial sequence
  Synthetic oligonucleotide
ctgccaatctgaacaacacg

SEQ ID NO: 2114 - DNA, 20 bp, Artificial sequence
  Synthetic oligonucleotide
gctgccaatctgaacaacac

SEQ ID NO: 2115 - DNA, 20 bp, Artificial sequence
  Synthetic oligonucleotide
cgctgccaatctgaacaaca

SEQ ID NO: 2116 - DNA, 20 bp, Artificial sequence
  Synthetic oligonucleotide
ccgctgccaatctgaacaac

SEQ ID NO: 2117 - DNA, 20 bp, Artificial sequence
  Synthetic oligonucleotide
gccgctgccaatctgaacaa

SEQ ID NO: 2118 - DNA, 20 bp, Artificial sequence
  Synthetic oligonucleotide
tgccgctgccaatctgaaca

SEQ ID NO: 2119 - DNA, 20 bp, Artificial sequence
  Synthetic oligonucleotide
atgccgctgccaatctgaac

SEQ ID NO: 2120 - DNA, 20 bp, Artificial sequence
  Synthetic oligonucleotide
aatgccgctgccaatctgaa

SEQ ID NO: 2121 - DNA, 20 bp, Artificial sequence
  Synthetic oligonucleotide
aaatgccgctgccaatctga

SEQ ID NO: 2122 - DNA, 20 bp, Artificial sequence
  Synthetic oligonucleotide
gaaatgccgctgccaatctg

SEQ ID NO: 2123 - DNA, 20 bp, Artificial sequence
  Synthetic oligonucleotide
cgaaatgccgctgccaatct

SEQ ID NO: 2124 - DNA, 20 bp, Artificial sequence
  Synthetic oligonucleotide
tcgaaatgccgctgccaatc

SEQ ID NO: 2125 - DNA, 20 bp, Artificial sequence
  Synthetic oligonucleotide
atcgaaatgccgctgccaat

SEQ ID NO: 2126 - DNA, 20 bp, Artificial sequence
  Synthetic oligonucleotide
catcgaaatgccgctgccaa

SEQ ID NO: 2127 - DNA, 20 bp, Artificial sequence
  Synthetic oligonucleotide
acatcgaaatgccgctgcca

SEQ ID NO: 2128 - DNA, 20 bp, Artificial sequence
  Synthetic oligonucleotide
tacatcgaaatgccgctgcc

SEQ ID NO: 2129 - DNA, 20 bp, Artificial sequence
  Synthetic oligonucleotide
ctacatcgaaatgccgctgc

SEQ ID NO: 2130 - DNA, 20 bp, Artificial sequence
  Synthetic oligonucleotide
gctacatcgaaatgccgctg

SEQ ID NO: 2131 - DNA, 20 bp, Artificial sequence
  Synthetic oligonucleotide
ggctacatcgaaatgccgct

SEQ ID NO: 2132 - DNA, 20 bp, Artificial sequence
  Synthetic oligonucleotide
ccagggctacatcgaaatgc

SEQ ID NO: 2133 - DNA, 20 bp, Artificial sequence
  Synthetic oligonucleotide
tcccagggctacatcgaaat

SEQ ID NO: 2134 - DNA, 20 bp, Artificial sequence
  Synthetic oligonucleotide
ttcccagggctacatcgaaa

SEQ ID NO: 2135 - DNA, 20 bp, Artificial sequence
  Synthetic oligonucleotide
cttcccagggctacatcgaa

SEQ ID NO: 2136 - DNA, 20 bp, Artificial sequence
  Synthetic oligonucleotide
tcttcccagggctacatcga

SEQ ID NO: 2137 - DNA, 20 bp, Artificial sequence
  Synthetic oligonucleotide
ttcttcccagggctacatcg

SEQ ID NO: 2138 - DNA, 20 bp, Artificial sequence
  Synthetic oligonucleotide
attcttcccagggctacatc

SEQ ID NO: 2139 - DNA, 20 bp, Artificial sequence
  Synthetic oligonucleotide
cattcttcccagggctacat

SEQ ID NO: 2140 - DNA, 20 bp, Artificial sequence
  Synthetic oligonucleotide
ccattcttcccagggctaca

SEQ ID NO: 2141 - DNA, 20 bp, Artificial sequence
  Synthetic oligonucleotide
accattcttcccagggctac

SEQ ID NO: 2142 - DNA, 20 bp, Artificial sequence
  Synthetic oligonucleotide
aaccattcttcccagggcta

SEQ ID NO: 2143 - DNA, 20 bp, Artificial sequence
  Synthetic oligonucleotide
aaaccattcttcccagggct

SEQ ID NO: 2144 - DNA, 20 bp, Artificial sequence
  Synthetic oligonucleotide
taaaccattcttcccagggc

SEQ ID NO: 2145 - DNA, 20 bp, Artificial sequence
  Synthetic oligonucleotide
ataaaccattcttcccaggg

SEQ ID NO: 2146 - DNA, 20 bp, Artificial sequence
  Synthetic oligonucleotide
cataaaccattcttcccagg

SEQ ID NO: 2147 - DNA, 20 bp, Artificial sequence
  Synthetic oligonucleotide
acataaaccattcttcccag

SEQ ID NO: 2148 - DNA, 20 bp, Artificial sequence
  Synthetic oligonucleotide
gacataaaccattcttccca

SEQ ID NO: 2149 - DNA, 20 bp, Artificial sequence
  Synthetic oligonucleotide
tgacataaaccattcttccc

SEQ ID NO: 2150 - DNA, 20 bp, Artificial sequence
  Synthetic oligonucleotide
ttgacataaaccattcttcc

SEQ ID NO: 2151 - DNA, 20 bp, Artificial sequence
  Synthetic oligonucleotide
gttgacataaaccattcttc

SEQ ID NO: 2152 - DNA, 20 bp, Artificial sequence
  Synthetic oligonucleotide
tgttgacataaaccattctt

SEQ ID NO: 2153 - DNA, 20 bp, Artificial sequence
  Synthetic oligonucleotide
ttgttgacataaaccattct

SEQ ID NO: 2154 - DNA, 20 bp, Artificial sequence
  Synthetic oligonucleotide
tttgttgacataaaccattc

SEQ ID NO: 2155 - DNA, 20 bp, Artificial sequence
  Synthetic oligonucleotide
ttttgttgacataaaccatt

SEQ ID NO: 2156 - DNA, 20 bp, Artificial sequence
  Synthetic oligonucleotide
attttgttgacataaaccat

SEQ ID NO: 2157 - DNA, 20 bp, Artificial sequence
  Synthetic oligonucleotide
cattttgttgacataaacca

SEQ ID NO: 2158 - DNA, 20 bp, Artificial sequence
  Synthetic oligonucleotide
tcattttgttgacataaacc

SEQ ID NO: 2159 - DNA, 20 bp, Artificial sequence
  Synthetic oligonucleotide
gagtccagtcattttgttga

SEQ ID NO: 2160 - DNA, 20 bp, Artificial sequence
  Synthetic oligonucleotide
tgagtccagtcattttgttg

SEQ ID NO: 2161 - DNA, 20 bp, Artificial sequence
  Synthetic oligonucleotide
ctgagtccagtcattttgtt

SEQ ID NO: 2162 - DNA, 20 bp, Artificial sequence
  Synthetic oligonucleotide
caatgaatgtgctgagtcca

SEQ ID NO: 2163 - DNA, 20 bp, Artificial sequence
  Synthetic oligonucleotide
aagcagcctgaatgtcctca

SEQ ID NO: 2164 - DNA, 20 bp, Artificial sequence
  Synthetic oligonucleotide
caagcagcctgaatgtcctc

SEQ ID NO: 2165 - DNA, 20 bp, Artificial sequence
  Synthetic oligonucleotide
acaagcagcctgaatgtcct

SEQ ID NO: 2166 - DNA, 20 bp, Artificial sequence
  Synthetic oligonucleotide
tacaagcagcctgaatgtcc

SEQ ID NO: 2167 - DNA, 20 bp, Artificial sequence
  Synthetic oligonucleotide
gtacaagcagcctgaatgtc

SEQ ID NO: 2168 - DNA, 20 bp, Artificial sequence
  Synthetic oligonucleotide
agtacaagcagcctgaatgt

SEQ ID NO: 2169 - DNA, 20 bp, Artificial sequence
  Synthetic oligonucleotide
tagtacaagcagcctgaatg

SEQ ID NO: 2170 - DNA, 20 bp, Artificial sequence
  Synthetic oligonucleotide
ttagtacaagcagcctgaat

SEQ ID NO: 2171 - DNA, 20 bp, Artificial sequence
  Synthetic oligonucleotide
tttagtacaagcagcctgaa

SEQ ID NO: 2172 - DNA, 20 bp, Artificial sequence
  Synthetic oligonucleotide
ctttagtacaagcagcctga

SEQ ID NO: 2173 - DNA, 20 bp, Artificial sequence
  Synthetic oligonucleotide
tctttagtacaagcagcctg

SEQ ID NO: 2174 - DNA, 20 bp, Artificial sequence
  Synthetic oligonucleotide
gtctttagtacaagcagcct

SEQ ID NO: 2175 - DNA, 20 bp, Artificial sequence
  Synthetic oligonucleotide
ggtctttagtacaagcagcc

SEQ ID NO: 2176 - DNA, 20 bp, Artificial sequence
  Synthetic oligonucleotide
aggtctttagtacaagcagc

SEQ ID NO: 2177 - DNA, 20 bp, Artificial sequence
  Synthetic oligonucleotide
caggtctttagtacaagcag

SEQ ID NO: 2178 - DNA, 20 bp, Artificial sequence
  Synthetic oligonucleotide
tcaggtctttagtacaagca

SEQ ID NO: 2179 - DNA, 20 bp, Artificial sequence
  Synthetic oligonucleotide
gtcaggtctttagtacaagc

SEQ ID NO: 2180 - DNA, 20 bp, Artificial sequence
  Synthetic oligonucleotide
tgtcaggtctttagtacaag

SEQ ID NO: 2181 - DNA, 20 bp, Artificial sequence
  Synthetic oligonucleotide
ttgtcaggtctttagtacaa

SEQ ID NO: 2182 - DNA, 20 bp, Artificial sequence
  Synthetic oligonucleotide
gttgtcaggtctttagtaca

SEQ ID NO: 2183 - DNA, 20 bp, Artificial sequence
  Synthetic oligonucleotide
agttgtcaggtctttagtac

SEQ ID NO: 2184 - DNA, 20 bp, Artificial sequence
  Synthetic oligonucleotide
cagttgtcaggtctttagta

SEQ ID NO: 2185 - DNA, 20 bp, Artificial sequence
  Synthetic oligonucleotide
acagttgtcaggtctttagt

SEQ ID NO: 2186 - DNA, 20 bp, Artificial sequence
  Synthetic oligonucleotide
cacagttgtcaggtctttag

SEQ ID NO: 2187 - DNA, 20 bp, Artificial sequence
  Synthetic oligonucleotide
ccacagttgtcaggtcttta

SEQ ID NO: 2188 - DNA, 20 bp, Artificial sequence
  Synthetic oligonucleotide
gccacagttgtcaggtcttt

SEQ ID NO: 2189 - DNA, 20 bp, Artificial sequence
  Synthetic oligonucleotide
agccacagttgtcaggtctt

SEQ ID NO: 2190 - DNA, 20 bp, Artificial sequence
  Synthetic oligonucleotide
cagccacagttgtcaggtct

SEQ ID NO: 2191 - DNA, 20 bp, Artificial sequence
  Synthetic oligonucleotide
acagccacagttgtcaggtc

SEQ ID NO: 2192 - DNA, 20 bp, Artificial sequence
  Synthetic oligonucleotide
cacagccacagttgtcaggt

SEQ ID NO: 2193 - DNA, 20 bp, Artificial sequence
  Synthetic oligonucleotide
tccacagccacagttgtcag

SEQ ID NO: 2194 - DNA, 20 bp, Artificial sequence
  Synthetic oligonucleotide
atccacagccacagttgtca

SEQ ID NO: 2195 - DNA, 20 bp, Artificial sequence
  Synthetic oligonucleotide
catccacagccacagttgtc

SEQ ID NO: 2196 - DNA, 20 bp, Artificial sequence
  Synthetic oligonucleotide
acatccacagccacagttgt

SEQ ID NO: 2197 - DNA, 20 bp, Artificial sequence
  Synthetic oligonucleotide
aacatccacagccacagttg

SEQ ID NO: 2198 - DNA, 20 bp, Artificial sequence
  Synthetic oligonucleotide
caacatccacagccacagtt

SEQ ID NO: 2199 - DNA, 20 bp, Artificial sequence
  Synthetic oligonucleotide
acaacatccacagccacagt

SEQ ID NO: 2200 - DNA, 20 bp, Artificial sequence
  Synthetic oligonucleotide
tacaacatccacagccacag

SEQ ID NO: 2201 - DNA, 20 bp, Artificial sequence
  Synthetic oligonucleotide
gtacaacatccacagccaca

SEQ ID NO: 2202 - DNA, 20 bp, Artificial sequence
  Synthetic oligonucleotide
agtacaacatccacagccac

SEQ ID NO: 2203 - DNA, 20 bp, Artificial sequence
  Synthetic oligonucleotide
aagtacaacatccacagcca

SEQ ID NO: 2204 - DNA, 20 bp, Artificial sequence
  Synthetic oligonucleotide
caagtacaacatccacagcc

SEQ ID NO: 2205 - DNA, 20 bp, Artificial sequence
  Synthetic oligonucleotide
tcaagtacaacatccacagc

SEQ ID NO: 2206 - DNA, 20 bp, Artificial sequence
  Synthetic oligonucleotide
ctcaagtacaacatccacag

SEQ ID NO: 2207 - DNA, 20 bp, Artificial sequence
  Synthetic oligonucleotide
tctcaagtacaacatccaca

SEQ ID NO: 2208 - DNA, 20 bp, Artificial sequence
  Synthetic oligonucleotide
ttctcaagtacaacatccac

SEQ ID NO: 2209 - DNA, 20 bp, Artificial sequence
  Synthetic oligonucleotide
attctcaagtacaacatcca

SEQ ID NO: 2210 - DNA, 20 bp, Artificial sequence
  Synthetic oligonucleotide
cattctcaagtacaacatcc

SEQ ID NO: 2211 - DNA, 20 bp, Artificial sequence
  Synthetic oligonucleotide
ccattctcaagtacaacatc

SEQ ID NO: 2212 - DNA, 20 bp, Artificial sequence
  Synthetic oligonucleotide
cccattctcaagtacaacat

SEQ ID NO: 2213 - DNA, 20 bp, Artificial sequence
  Synthetic oligonucleotide
acccattctcaagtacaaca

SEQ ID NO: 2214 - DNA, 20 bp, Artificial sequence
  Synthetic oligonucleotide
gacccattctcaagtacaac

SEQ ID NO: 2215 - DNA, 20 bp, Artificial sequence
  Synthetic oligonucleotide
agacccattctcaagtacaa

SEQ ID NO: 2216 - DNA, 20 bp, Artificial sequence
  Synthetic oligonucleotide
cctgtactgagacccattct

SEQ ID NO: 2217 - DNA, 20 bp, Artificial sequence
  Synthetic oligonucleotide
acctgtactgagacccattc

SEQ ID NO: 2218 - DNA, 20 bp, Artificial sequence
  Synthetic oligonucleotide
cacctgtactgagacccatt

SEQ ID NO: 2219 - DNA, 20 bp, Artificial sequence
  Synthetic oligonucleotide
acacctgtactgagacccat

SEQ ID NO: 2220 - DNA, 20 bp, Artificial sequence
  Synthetic oligonucleotide
gacacctgtactgagaccca

SEQ ID NO: 2221 - DNA, 20 bp, Artificial sequence
  Synthetic oligonucleotide
tgacacctgtactgagaccc

SEQ ID NO: 2222 - DNA, 20 bp, Artificial sequence
  Synthetic oligonucleotide
ttgacacctgtactgagacc

SEQ ID NO: 2223 - DNA, 20 bp, Artificial sequence
  Synthetic oligonucleotide
gttgacacctgtactgagac

SEQ ID NO: 2224 - DNA, 20 bp, Artificial sequence
  Synthetic oligonucleotide
cgcttctaaaaggttgacac

SEQ ID NO: 2225 - DNA, 20 bp, Artificial sequence
  Synthetic oligonucleotide
tcgcttctaaaaggttgaca

SEQ ID NO: 2226 - DNA, 20 bp, Artificial sequence
  Synthetic oligonucleotide
gtcgcttctaaaaggttgac

SEQ ID NO: 2227 - DNA, 20 bp, Artificial sequence
  Synthetic oligonucleotide
ggtcgcttctaaaaggttga

SEQ ID NO: 2228 - DNA, 20 bp, Artificial sequence
  Synthetic oligonucleotide
aggtcgcttctaaaaggttg

SEQ ID NO: 2229 - DNA, 20 bp, Artificial sequence
  Synthetic oligonucleotide
aaggtcgcttctaaaaggtt

SEQ ID NO: 2230 - DNA, 20 bp, Artificial sequence
  Synthetic oligonucleotide
caaggtcgcttctaaaaggt

SEQ ID NO: 2231 - DNA, 20 bp, Artificial sequence
  Synthetic oligonucleotide
acaaggtcgcttctaaaagg

SEQ ID NO: 2232 - DNA, 20 bp, Artificial sequence
  Synthetic oligonucleotide
aacaaggtcgcttctaaaag

SEQ ID NO: 2233 - DNA, 20 bp, Artificial sequence
  Synthetic oligonucleotide
gaacaaggtcgcttctaaaa

SEQ ID NO: 2234 - DNA, 20 bp, Artificial sequence
  Synthetic oligonucleotide
agaacaaggtcgcttctaaa

SEQ ID NO: 2235 - DNA, 20 bp, Artificial sequence
  Synthetic oligonucleotide
aagaacaaggtcgcttctaa

SEQ ID NO: 2236 - DNA, 20 bp, Artificial sequence
  Synthetic oligonucleotide
gaagaacaaggtcgcttcta

SEQ ID NO: 2237 - DNA, 20 bp, Artificial sequence
  Synthetic oligonucleotide
ggaagaacaaggtcgcttct

SEQ ID NO: 2238 - DNA, 20 bp, Artificial sequence
  Synthetic oligonucleotide
aggaagaacaaggtcgcttc

SEQ ID NO: 2239 - DNA, 20 bp, Artificial sequence
  Synthetic oligonucleotide
aaggaagaacaaggtcgctt

SEQ ID NO: 2240 - DNA, 20 bp, Artificial sequence
  Synthetic oligonucleotide
aaaggaagaacaaggtcgct

SEQ ID NO: 2241 - DNA, 20 bp, Artificial sequence
  Synthetic oligonucleotide
gaaaggaagaacaaggtcgc

SEQ ID NO: 2242 - DNA, 20 bp, Artificial sequence
  Synthetic oligonucleotide
ggaaaggaagaacaaggtcg

SEQ ID NO: 2243 - DNA, 20 bp, Artificial sequence
  Synthetic oligonucleotide
aggaaaggaagaacaaggtc

SEQ ID NO: 2244 - DNA, 20 bp, Artificial sequence
  Synthetic oligonucleotide
aaggaaaggaagaacaaggt

SEQ ID NO: 2245 - DNA, 20 bp, Artificial sequence
  Synthetic oligonucleotide
gaaggaaaggaagaacaagg

SEQ ID NO: 2246 - DNA, 20 bp, Artificial sequence
  Synthetic oligonucleotide
ggaaggaaaggaagaacaag

SEQ ID NO: 2247 - DNA, 20 bp, Artificial sequence
  Synthetic oligonucleotide
cggaaggaaaggaagaacaa

SEQ ID NO: 2248 - DNA, 20 bp, Artificial sequence
  Synthetic oligonucleotide
tcggaaggaaaggaagaaca

SEQ ID NO: 2249 - DNA, 20 bp, Artificial sequence
  Synthetic oligonucleotide
ctcggaaggaaaggaagaac

SEQ ID NO: 2250 - DNA, 20 bp, Artificial sequence
  Synthetic oligonucleotide
tctcggaaggaaaggaagaa

SEQ ID NO: 2251 - DNA, 20 bp, Artificial sequence
  Synthetic oligonucleotide
ctctcggaaggaaaggaaga

SEQ ID NO: 2252 - DNA, 20 bp, Artificial sequence
  Synthetic oligonucleotide
gctctcggaaggaaaggaag

SEQ ID NO: 2253 - DNA, 20 bp, Artificial sequence
  Synthetic oligonucleotide
agctctcggaaggaaaggaa

SEQ ID NO: 2254 - DNA, 20 bp, Artificial sequence
  Synthetic oligonucleotide
gagctctcggaaggaaagga

SEQ ID NO: 2255 - DNA, 20 bp, Artificial sequence
  Synthetic oligonucleotide
gtctcatcacagtcctctct

SEQ ID NO: 2256 - DNA, 20 bp, Artificial sequence
  Synthetic oligonucleotide
tgtctcatcacagtcctctc

SEQ ID NO: 2257 - DNA, 20 bp, Artificial sequence
  Synthetic oligonucleotide
tgttatcctgtctcatcaca

SEQ ID NO: 2258 - DNA, 20 bp, Artificial sequence
  Synthetic oligonucleotide
ctgttatcctgtctcatcac

SEQ ID NO: 2259 - DNA, 20 bp, Artificial sequence
  Synthetic oligonucleotide
tctgttatcctgtctcatca

SEQ ID NO: 2260 - DNA, 20 bp, Artificial sequence
  Synthetic oligonucleotide
ctctgttatcctgtctcatc

SEQ ID NO: 2261 - DNA, 20 bp, Artificial sequence
  Synthetic oligonucleotide
tctctgttatcctgtctcat

SEQ ID NO: 2262 - DNA, 20 bp, Artificial sequence
  Synthetic oligonucleotide
atctctgttatcctgtctca

SEQ ID NO: 2263 - DNA, 20 bp, Artificial sequence
  Synthetic oligonucleotide
tatctctgttatcctgtctc

SEQ ID NO: 2264 - DNA, 20 bp, Artificial sequence
  Synthetic oligonucleotide
gtatctctgttatcctgtct

SEQ ID NO: 2265 - DNA, 20 bp, Artificial sequence
  Synthetic oligonucleotide
agtatctctgttatcctgtc

SEQ ID NO: 2266 - DNA, 20 bp, Artificial sequence
  Synthetic oligonucleotide
gtatcatccacagtatctct

SEQ ID NO: 2267 - DNA, 20 bp, Artificial sequence
  Synthetic oligonucleotide
agtatcatccacagtatctc

SEQ ID NO: 2268 - DNA, 20 bp, Artificial sequence
  Synthetic oligonucleotide
cagtatcatccacagtatct

SEQ ID NO: 2269 - DNA, 20 bp, Artificial sequence
  Synthetic oligonucleotide
acagtatcatccacagtatc

SEQ ID NO: 2270 - DNA, 20 bp, Artificial sequence
  Synthetic oligonucleotide
aacagtatcatccacagtat

SEQ ID NO: 2271 - DNA, 20 bp, Artificial sequence
  Synthetic oligonucleotide
taacagtatcatccacagta

SEQ ID NO: 2272 - DNA, 20 bp, Artificial sequence
  Synthetic oligonucleotide
ctaacagtatcatccacagt

SEQ ID NO: 2273 - DNA, 20 bp, Artificial sequence
  Synthetic oligonucleotide
actaacagtatcatccacag

SEQ ID NO: 2274 - DNA, 20 bp, Artificial sequence
  Synthetic oligonucleotide
tactaacagtatcatccaca

SEQ ID NO: 2275 - DNA, 20 bp, Artificial sequence
  Synthetic oligonucleotide
ctactaacagtatcatccac

SEQ ID NO: 2276 - DNA, 20 bp, Artificial sequence
  Synthetic oligonucleotide
gctactaacagtatcatcca

SEQ ID NO: 2277 - DNA, 20 bp, Artificial sequence
  Synthetic oligonucleotide
cgctactaacagtatcatcc

SEQ ID NO: 2278 - DNA, 20 bp, Artificial sequence
  Synthetic oligonucleotide
tcgctactaacagtatcatc

SEQ ID NO: 2279 - DNA, 20 bp, Artificial sequence
  Synthetic oligonucleotide
ttcgctactaacagtatcat

SEQ ID NO: 2280 - DNA, 20 bp, Artificial sequence
  Synthetic oligonucleotide
attcgctactaacagtatca

SEQ ID NO: 2281 - DNA, 20 bp, Artificial sequence
  Synthetic oligonucleotide
gattcgctactaacagtatc

SEQ ID NO: 2282 - DNA, 20 bp, Artificial sequence
  Synthetic oligonucleotide
cgattcgctactaacagtat

SEQ ID NO: 2283 - DNA, 20 bp, Artificial sequence
  Synthetic oligonucleotide
acaaagactgaagcgattcg

SEQ ID NO: 2284 - DNA, 20 bp, Artificial sequence
  Synthetic oligonucleotide
aacaaagactgaagcgattc

SEQ ID NO: 2285 - DNA, 20 bp, Artificial sequence
  Synthetic oligonucleotide
gaacaaagactgaagcgatt

SEQ ID NO: 2286 - DNA, 20 bp, Artificial sequence
  Synthetic oligonucleotide
agaacaaagactgaagcgat

SEQ ID NO: 2287 - DNA, 20 bp, Artificial sequence
  Synthetic oligonucleotide
gagaacaaagactgaagcga

SEQ ID NO: 2288 - DNA, 20 bp, Artificial sequence
  Synthetic oligonucleotide
tgagaacaaagactgaagcg

SEQ ID NO: 2289 - DNA, 20 bp, Artificial sequence
  Synthetic oligonucleotide
ctgagaacaaagactgaagc

SEQ ID NO: 2290 - DNA, 20 bp, Artificial sequence
  Synthetic oligonucleotide
tctgagaacaaagactgaag

SEQ ID NO: 2291 - DNA, 20 bp, Artificial sequence
  Synthetic oligonucleotide
ttctgagaacaaagactgaa

SEQ ID NO: 2292 - DNA, 20 bp, Artificial sequence
  Synthetic oligonucleotide
attctgagaacaaagactga

SEQ ID NO: 2293 - DNA, 20 bp, Artificial sequence
  Synthetic oligonucleotide
cattctgagaacaaagactg

SEQ ID NO: 2294 - DNA, 20 bp, Artificial sequence
  Synthetic oligonucleotide
ccattctgagaacaaagact

SEQ ID NO: 2295 - DNA, 20 bp, Artificial sequence
  Synthetic oligonucleotide
cccattctgagaacaaagac

SEQ ID NO: 2296 - DNA, 20 bp, Artificial sequence
  Synthetic oligonucleotide
tcccattctgagaacaaaga

SEQ ID NO: 2297 - DNA, 20 bp, Artificial sequence
  Synthetic oligonucleotide
gtcccattctgagaacaaag

SEQ ID NO: 2298 - DNA, 20 bp, Artificial sequence
  Synthetic oligonucleotide
tgtcccattctgagaacaaa

SEQ ID NO: 2299 - DNA, 20 bp, Artificial sequence
  Synthetic oligonucleotide
ttgtcccattctgagaacaa

SEQ ID NO: 2300 - DNA, 20 bp, Artificial sequence
  Synthetic oligonucleotide
attgtcccattctgagaaca

SEQ ID NO: 2301 - DNA, 20 bp, Artificial sequence
  Synthetic oligonucleotide
gattgtcccattctgagaac

SEQ ID NO: 2302 - DNA, 20 bp, Artificial sequence
  Synthetic oligonucleotide
ggattgtcccattctgagaa

SEQ ID NO: 2303 - DNA, 20 bp, Artificial sequence
  Synthetic oligonucleotide
tggattgtcccattctgaga

SEQ ID NO: 2304 - DNA, 20 bp, Artificial sequence
  Synthetic oligonucleotide
ctggattgtcccattctgag

SEQ ID NO: 2305 - DNA, 20 bp, Artificial sequence
  Synthetic oligonucleotide
actggattgtcccattctga

SEQ ID NO: 2306 - DNA, 20 bp, Artificial sequence
  Synthetic oligonucleotide
tactggattgtcccattctg

SEQ ID NO: 2307 - DNA, 20 bp, Artificial sequence
  Synthetic oligonucleotide
atactggattgtcccattct

SEQ ID NO: 2308 - DNA, 20 bp, Artificial sequence
  Synthetic oligonucleotide
aatactggattgtcccattc

SEQ ID NO: 2309 - DNA, 20 bp, Artificial sequence
  Synthetic oligonucleotide
aaatactggattgtcccatt

SEQ ID NO: 2310 - DNA, 20 bp, Artificial sequence
  Synthetic oligonucleotide
caaatactggattgtcccat

SEQ ID NO: 2311 - DNA, 20 bp, Artificial sequence
  Synthetic oligonucleotide
gcaaatactggattgtccca

SEQ ID NO: 2312 - DNA, 20 bp, Artificial sequence
  Synthetic oligonucleotide
ggcaaatactggattgtccc

SEQ ID NO: 2313 - DNA, 20 bp, Artificial sequence
  Synthetic oligonucleotide
cgggcaaatactggattgtc

SEQ ID NO: 2314 - DNA, 20 bp, Artificial sequence
  Synthetic oligonucleotide
acgggcaaatactggattgt

SEQ ID NO: 2315 - DNA, 20 bp, Artificial sequence
  Synthetic oligonucleotide
aacgggcaaatactggattg

SEQ ID NO: 2316 - DNA, 20 bp, Artificial sequence
  Synthetic oligonucleotide
taacgggcaaatactggatt

SEQ ID NO: 2317 - DNA, 20 bp, Artificial sequence
  Synthetic oligonucleotide
ataacgggcaaatactggat

SEQ ID NO: 2318 - DNA, 20 bp, Artificial sequence
  Synthetic oligonucleotide
gataacgggcaaatactgga

SEQ ID NO: 2319 - DNA, 20 bp, Artificial sequence
  Synthetic oligonucleotide
ggataacgggcaaatactgg

SEQ ID NO: 2320 - DNA, 20 bp, Artificial sequence
  Synthetic oligonucleotide
tggataacgggcaaatactg

SEQ ID NO: 2321 - DNA, 20 bp, Artificial sequence
  Synthetic oligonucleotide
ctggataacgggcaaatact

SEQ ID NO: 2322 - DNA, 20 bp, Artificial sequence
  Synthetic oligonucleotide
tctggataacgggcaaatac

SEQ ID NO: 2323 - DNA, 20 bp, Artificial sequence
  Synthetic oligonucleotide
ctctggataacgggcaaata

SEQ ID NO: 2324 - DNA, 20 bp, Artificial sequence
  Synthetic oligonucleotide
cctctggataacgggcaaat

SEQ ID NO: 2325 - DNA, 20 bp, Artificial sequence
  Synthetic oligonucleotide
acctctggataacgggcaaa

SEQ ID NO: 2326 - DNA, 20 bp, Artificial sequence
  Synthetic oligonucleotide
aacctctggataacgggcaa

SEQ ID NO: 2327 - DNA, 20 bp, Artificial sequence
  Synthetic oligonucleotide
caacctctggataacgggca

SEQ ID NO: 2328 - DNA, 20 bp, Artificial sequence
  Synthetic oligonucleotide
agcaacctctggataacggg

SEQ ID NO: 2329 - DNA, 20 bp, Artificial sequence
  Synthetic oligonucleotide
cagcaacctctggataacgg

SEQ ID NO: 2330 - DNA, 20 bp, Artificial sequence
  Synthetic oligonucleotide
ttacatcaacagcaacctct

SEQ ID NO: 2331 - DNA, 20 bp, Artificial sequence
  Synthetic oligonucleotide
cttacatcaacagcaacctc

SEQ ID NO: 2332 - DNA, 20 bp, Artificial sequence
  Synthetic oligonucleotide
gcttacatcaacagcaacct

SEQ ID NO: 2333 - DNA, 20 bp, Artificial sequence
  Synthetic oligonucleotide
ccactgcttacatcaacagc

SEQ ID NO: 2334 - DNA, 20 bp, Artificial sequence
  Synthetic oligonucleotide
gccactgcttacatcaacag

SEQ ID NO: 2335 - DNA, 20 bp, Artificial sequence
  Synthetic oligonucleotide
tttaactgctaagctctcag

SEQ ID NO: 2336 - DNA, 20 bp, Artificial sequence
  Synthetic oligonucleotide
ttttaactgctaagctctca

SEQ ID NO: 2337 - DNA, 20 bp, Artificial sequence
  Synthetic oligonucleotide
attttaactgctaagctctc

SEQ ID NO: 2338 - DNA, 20 bp, Artificial sequence
  Synthetic oligonucleotide
aattttaactgctaagctct

SEQ ID NO: 2339 - DNA, 20 bp, Artificial sequence
  Synthetic oligonucleotide
gaattttaactgctaagctc

SEQ ID NO: 2340 - DNA, 20 bp, Artificial sequence
  Synthetic oligonucleotide
tgaattttaactgctaagct

SEQ ID NO: 2341 - DNA, 20 bp, Artificial sequence
  Synthetic oligonucleotide
gtgaattttaactgctaagc

SEQ ID NO: 2342 - DNA, 20 bp, Artificial sequence
  Synthetic oligonucleotide
tgtgaattttaactgctaag

SEQ ID NO: 2343 - DNA, 20 bp, Artificial sequence
  Synthetic oligonucleotide
ttgtgaattttaactgctaa

SEQ ID NO: 2344 - DNA, 20 bp, Artificial sequence
  Synthetic oligonucleotide
gttgtgaattttaactgcta

SEQ ID NO: 2345 - DNA, 20 bp, Artificial sequence
  Synthetic oligonucleotide
tgttgtgaattttaactgct

SEQ ID NO: 2346 - DNA, 20 bp, Artificial sequence
  Synthetic oligonucleotide
atgttgtgaattttaactgc

SEQ ID NO: 2347 - DNA, 20 bp, Artificial sequence
  Synthetic oligonucleotide
gatgttgtgaattttaactg

SEQ ID NO: 2348 - DNA, 20 bp, Artificial sequence
  Synthetic oligonucleotide
agatgttgtgaattttaact

SEQ ID NO: 2349 - DNA, 20 bp, Artificial sequence
  Synthetic oligonucleotide
aagatgttgtgaattttaac

SEQ ID NO: 2350 - DNA, 20 bp, Artificial sequence
  Synthetic oligonucleotide
caagatgttgtgaattttaa

SEQ ID NO: 2351 - DNA, 20 bp, Artificial sequence
  Synthetic oligonucleotide
ggtgaaacgatagggataca

SEQ ID NO: 2352 - DNA, 20 bp, Artificial sequence
  Synthetic oligonucleotide
tggtgaaacgatagggatac

SEQ ID NO: 2353 - DNA, 20 bp, Artificial sequence
  Synthetic oligonucleotide
ttggtgaaacgatagggata

SEQ ID NO: 2354 - DNA, 20 bp, Artificial sequence
  Synthetic oligonucleotide
tttggtgaaacgatagggat

SEQ ID NO: 2355 - DNA, 20 bp, Artificial sequence
  Synthetic oligonucleotide
ctttggtgaaacgataggga

SEQ ID NO: 2356 - DNA, 20 bp, Artificial sequence
  Synthetic oligonucleotide
cctttggtgaaacgataggg

SEQ ID NO: 2357 - DNA, 20 bp, Artificial sequence
  Synthetic oligonucleotide
ttcctttggtgaaacgatag

SEQ ID NO: 2358 - DNA, 20 bp, Artificial sequence
  Synthetic oligonucleotide
attcctttggtgaaacgata

SEQ ID NO: 2359 - DNA, 20 bp, Artificial sequence
  Synthetic oligonucleotide
cattcctttggtgaaacgat

SEQ ID NO: 2360 - DNA, 20 bp, Artificial sequence
  Synthetic oligonucleotide
tcattcctttggtgaaacga

SEQ ID NO: 2361 - DNA, 20 bp, Artificial sequence
  Synthetic oligonucleotide
atcattcctttggtgaaacg

SEQ ID NO: 2362 - DNA, 20 bp, Artificial sequence
  Synthetic oligonucleotide
aatcattcctttggtgaaac

SEQ ID NO: 2363 - DNA, 20 bp, Artificial sequence
  Synthetic oligonucleotide
gaatcattcctttggtgaaa

SEQ ID NO: 2364 - DNA, 20 bp, Artificial sequence
  Synthetic oligonucleotide
tgaatcattcctttggtgaa

SEQ ID NO: 2365 - DNA, 20 bp, Artificial sequence
  Synthetic oligonucleotide
atgaatcattcctttggtga

SEQ ID NO: 2366 - DNA, 20 bp, Artificial sequence
  Synthetic oligonucleotide
aatgaatcattcctttggtg

SEQ ID NO: 2367 - DNA, 20 bp, Artificial sequence
  Synthetic oligonucleotide
cctgcattgaatgaatcatt

SEQ ID NO: 2368 - DNA, 20 bp, Artificial sequence
  Synthetic oligonucleotide
acctgcattgaatgaatcat

SEQ ID NO: 2369 - DNA, 20 bp, Artificial sequence
  Synthetic oligonucleotide
aacctgcattgaatgaatca

SEQ ID NO: 2370 - DNA, 20 bp, Artificial sequence
  Synthetic oligonucleotide
gaacctgcattgaatgaatc

SEQ ID NO: 2371 - DNA, 20 bp, Artificial sequence
  Synthetic oligonucleotide
agaacctgcattgaatgaat

SEQ ID NO: 2372 - DNA, 20 bp, Artificial sequence
  Synthetic oligonucleotide
gagaacctgcattgaatgaa

SEQ ID NO: 2373 - DNA, 20 bp, Artificial sequence
  Synthetic oligonucleotide
ggagaacctgcattgaatga

SEQ ID NO: 2374 - DNA, 20 bp, Artificial sequence
  Synthetic oligonucleotide
tatctacttgctggagaacc

SEQ ID NO: 2375 - DNA, 20 bp, Artificial sequence
  Synthetic oligonucleotide
ttatctacttgctggagaac

SEQ ID NO: 2376 - DNA, 20 bp, Artificial sequence
  Synthetic oligonucleotide
gttatctacttgctggagaa

SEQ ID NO: 2377 - DNA, 20 bp, Artificial sequence
  Synthetic oligonucleotide
tgttatctacttgctggaga

SEQ ID NO: 2378 - DNA, 20 bp, Artificial sequence
  Synthetic oligonucleotide
ttgttatctacttgctggag

SEQ ID NO: 2379 - DNA, 20 bp, Artificial sequence
  Synthetic oligonucleotide
cttgttatctacttgctgga

SEQ ID NO: 2380 - DNA, 20 bp, Artificial sequence
  Synthetic oligonucleotide
acttgttatctacttgctgg

SEQ ID NO: 2381 - DNA, 20 bp, Artificial sequence
  Synthetic oligonucleotide
aacttgttatctacttgctg

SEQ ID NO: 2382 - DNA, 20 bp, Artificial sequence
  Synthetic oligonucleotide
aaacttgttatctacttgct

SEQ ID NO: 2383 - DNA, 20 bp, Artificial sequence
  Synthetic oligonucleotide
taaacttgttatctacttgc

SEQ ID NO: 2384 - DNA, 20 bp, Artificial sequence
  Synthetic oligonucleotide
ataaacttgttatctacttg

SEQ ID NO: 2385 - DNA, 20 bp, Artificial sequence
  Synthetic oligonucleotide
caataaacttgttatctact

SEQ ID NO: 2386 - DNA, 20 bp, Artificial sequence
  Synthetic oligonucleotide
gcaataaacttgttatctac

SEQ ID NO: 2387 - DNA, 20 bp, Artificial sequence
  Synthetic oligonucleotide
ggcaataaacttgttatcta

SEQ ID NO: 2388 - DNA, 20 bp, Artificial sequence
  Synthetic oligonucleotide
aggcaataaacttgttatct

SEQ ID NO: 2389 - DNA, 20 bp, Artificial sequence
  Synthetic oligonucleotide
caggcaataaacttgttatc

SEQ ID NO: 2390 - DNA, 20 bp, Artificial sequence
  Synthetic oligonucleotide
acaggcaataaacttgttat

SEQ ID NO: 2391 - DNA, 20 bp, Artificial sequence
  Synthetic oligonucleotide
aacaggcaataaacttgtta

SEQ ID NO: 2392 - DNA, 20 bp, Artificial sequence
  Synthetic oligonucleotide
aaacaggcaataaacttgtt

SEQ ID NO: 2393 - DNA, 20 bp, Artificial sequence
  Synthetic oligonucleotide
caaacaggcaataaacttgt

SEQ ID NO: 2394 - DNA, 20 bp, Artificial sequence
  Synthetic oligonucleotide
tcaaacaggcaataaacttg

SEQ ID NO: 2395 - DNA, 20 bp, Artificial sequence
  Synthetic oligonucleotide
atcaaacaggcaataaactt

SEQ ID NO: 2396 - DNA, 20 bp, Artificial sequence
  Synthetic oligonucleotide
catcaaacaggcaataaact

SEQ ID NO: 2397 - DNA, 20 bp, Artificial sequence
  Synthetic oligonucleotide
tcatcaaacaggcaataaac

SEQ ID NO: 2398 - DNA, 20 bp, Artificial sequence
  Synthetic oligonucleotide
ctcatcaaacaggcaataaa

SEQ ID NO: 2399 - DNA, 20 bp, Artificial sequence
  Synthetic oligonucleotide
gctcatcaaacaggcaataa

SEQ ID NO: 2400 - DNA, 20 bp, Artificial sequence
  Synthetic oligonucleotide
tgctcatcaaacaggcaata

SEQ ID NO: 2401 - DNA, 20 bp, Artificial sequence
  Synthetic oligonucleotide
gtgctcatcaaacaggcaat

SEQ ID NO: 2402 - DNA, 20 bp, Artificial sequence
  Synthetic oligonucleotide
agtgctcatcaaacaggcaa

SEQ ID NO: 2403 - DNA, 20 bp, Artificial sequence
  Synthetic oligonucleotide
tagtgctcatcaaacaggca

SEQ ID NO: 2404 - DNA, 20 bp, Artificial sequence
  Synthetic oligonucleotide
ttagtgctcatcaaacaggc

SEQ ID NO: 2405 - DNA, 20 bp, Artificial sequence
  Synthetic oligonucleotide
cttagtgctcatcaaacagg

SEQ ID NO: 2406 - DNA, 20 bp, Artificial sequence
  Synthetic oligonucleotide
tcttagtgctcatcaaacag

SEQ ID NO: 2407 - DNA, 20 bp, Artificial sequence
  Synthetic oligonucleotide
gtcttagtgctcatcaaaca

SEQ ID NO: 2408 - DNA, 20 bp, Artificial sequence
  Synthetic oligonucleotide
agtcttagtgctcatcaaac

SEQ ID NO: 2409 - DNA, 20 bp, Artificial sequence
  Synthetic oligonucleotide
cagtcttagtgctcatcaaa

SEQ ID NO: 2410 - DNA, 20 bp, Artificial sequence
  Synthetic oligonucleotide
tcagtcttagtgctcatcaa

SEQ ID NO: 2411 - DNA, 20 bp, Artificial sequence
  Synthetic oligonucleotide
ttcagtcttagtgctcatca

SEQ ID NO: 2412 - DNA, 20 bp, Artificial sequence
  Synthetic oligonucleotide
cttcagtcttagtgctcatc

SEQ ID NO: 2413 - DNA, 20 bp, Artificial sequence
  Synthetic oligonucleotide
tcttcagtcttagtgctcat

SEQ ID NO: 2414 - DNA, 20 bp, Artificial sequence
  Synthetic oligonucleotide
ctcttcagtcttagtgctca

SEQ ID NO: 2415 - DNA, 20 bp, Artificial sequence
  Synthetic oligonucleotide
tctcttcagtcttagtgctc

SEQ ID NO: 2416 - DNA, 20 bp, Artificial sequence
  Synthetic oligonucleotide
ttctcttcagtcttagtgct

SEQ ID NO: 2417 - DNA, 20 bp, Artificial sequence
  Synthetic oligonucleotide
attctcttcagtcttagtgc

SEQ ID NO: 2418 - DNA, 20 bp, Artificial sequence
  Synthetic oligonucleotide
cattctcttcagtcttagtg

SEQ ID NO: 2419 - DNA, 20 bp, Artificial sequence
  Synthetic oligonucleotide
ccattctcttcagtcttagt

SEQ ID NO: 2420 - DNA, 20 bp, Artificial sequence
  Synthetic oligonucleotide
gccattctcttcagtcttag

SEQ ID NO: 2421 - DNA, 20 bp, Artificial sequence
  Synthetic oligonucleotide
cgccattctcttcagtctta

SEQ ID NO: 2422 - DNA, 20 bp, Artificial sequence
  Synthetic oligonucleotide
tcgccattctcttcagtctt

SEQ ID NO: 2423 - DNA, 20 bp, Artificial sequence
  Synthetic oligonucleotide
ctcgccattctcttcagtct

SEQ ID NO: 2424 - DNA, 20 bp, Artificial sequence
  Synthetic oligonucleotide
cctcgccattctcttcagtc

SEQ ID NO: 2425 - DNA, 20 bp, Artificial sequence
  Synthetic oligonucleotide
gcctcgccattctcttcagt

SEQ ID NO: 2426 - DNA, 20 bp, Artificial sequence
  Synthetic oligonucleotide
tgcctcgccattctcttcag

SEQ ID NO: 2427 - DNA, 20 bp, Artificial sequence
  Synthetic oligonucleotide
ctgcctcgccattctcttca

SEQ ID NO: 2428 - DNA, 20 bp, Artificial sequence
  Synthetic oligonucleotide
acctgcctcgccattctctt

SEQ ID NO: 2429 - DNA, 20 bp, Artificial sequence
  Synthetic oligonucleotide
agctgctccagacgtatacg

SEQ ID NO: 2430 - DNA, 20 bp, Artificial sequence
  Synthetic oligonucleotide
aagctgctccagacgtatac

SEQ ID NO: 2431 - DNA, 20 bp, Artificial sequence
  Synthetic oligonucleotide
taagctgctccagacgtata

SEQ ID NO: 2432 - DNA, 20 bp, Artificial sequence
  Synthetic oligonucleotide
ataagctgctccagacgtat

SEQ ID NO: 2433 - DNA, 20 bp, Artificial sequence
  Synthetic oligonucleotide
gataagctgctccagacgta

SEQ ID NO: 2434 - DNA, 20 bp, Artificial sequence
  Synthetic oligonucleotide
tgataagctgctccagacgt

SEQ ID NO: 2435 - DNA, 20 bp, Artificial sequence
  Synthetic oligonucleotide
atgataagctgctccagacg

SEQ ID NO: 2436 - DNA, 20 bp, Artificial sequence
  Synthetic oligonucleotide
aatgataagctgctccagac

SEQ ID NO: 2437 - DNA, 20 bp, Artificial sequence
  Synthetic oligonucleotide
caatgataagctgctccaga

SEQ ID NO: 2438 - DNA, 20 bp, Artificial sequence
  Synthetic oligonucleotide
tcaatgataagctgctccag

SEQ ID NO: 2439 - DNA, 20 bp, Artificial sequence
  Synthetic oligonucleotide
atcaatgataagctgctcca

SEQ ID NO: 2440 - DNA, 20 bp, Artificial sequence
  Synthetic oligonucleotide
aatcaatgataagctgctcc

SEQ ID NO: 2441 - DNA, 20 bp, Artificial sequence
  Synthetic oligonucleotide
gaatcaatgataagctgctc

SEQ ID NO: 2442 - DNA, 20 bp, Artificial sequence
  Synthetic oligonucleotide
ggaatcaatgataagctgct

SEQ ID NO: 2443 - DNA, 20 bp, Artificial sequence
  Synthetic oligonucleotide
aggaatcaatgataagctgc

SEQ ID NO: 2444 - DNA, 20 bp, Artificial sequence
  Synthetic oligonucleotide
taggaatcaatgataagctg

SEQ ID NO: 2445 - DNA, 20 bp, Artificial sequence
  Synthetic oligonucleotide
gtaggaatcaatgataagct

SEQ ID NO: 2446 - DNA, 20 bp, Artificial sequence
  Synthetic oligonucleotide
cgtaggaatcaatgataagc

SEQ ID NO: 2447 - DNA, 20 bp, Artificial sequence
  Synthetic oligonucleotide
tcgtaggaatcaatgataag

SEQ ID NO: 2448 - DNA, 20 bp, Artificial sequence
  Synthetic oligonucleotide
ctcgtaggaatcaatgataa

SEQ ID NO: 2449 - DNA, 20 bp, Artificial sequence
  Synthetic oligonucleotide
tctcgtaggaatcaatgata

SEQ ID NO: 2450 - DNA, 20 bp, Artificial sequence
  Synthetic oligonucleotide
ttctcgtaggaatcaatgat

SEQ ID NO: 2451 - DNA, 20 bp, Artificial sequence
  Synthetic oligonucleotide
cttctcgtaggaatcaatga

SEQ ID NO: 2452 - DNA, 20 bp, Artificial sequence
  Synthetic oligonucleotide
gcttctcgtaggaatcaatg

SEQ ID NO: 2453 - DNA, 20 bp, Artificial sequence
  Synthetic oligonucleotide
tgcttctcgtaggaatcaat

SEQ ID NO: 2454 - DNA, 20 bp, Artificial sequence
  Synthetic oligonucleotide
ttgcttctcgtaggaatcaa

SEQ ID NO: 2455 - DNA, 20 bp, Artificial sequence
  Synthetic oligonucleotide
gttgcttctcgtaggaatca

SEQ ID NO: 2456 - DNA, 20 bp, Artificial sequence
  Synthetic oligonucleotide
tgttgcttctcgtaggaatc

SEQ ID NO: 2457 - DNA, 20 bp, Artificial sequence
  Synthetic oligonucleotide
ctgttgcttctcgtaggaat

SEQ ID NO: 2458 - DNA, 20 bp, Artificial sequence
  Synthetic oligonucleotide
cctgttgcttctcgtaggaa

SEQ ID NO: 2459 - DNA, 20 bp, Artificial sequence
  Synthetic oligonucleotide
gcctgttgcttctcgtagga

SEQ ID NO: 2460 - DNA, 20 bp, Artificial sequence
  Synthetic oligonucleotide
tttccgaccagagccttgtg

SEQ ID NO: 2461 - DNA, 20 bp, Artificial sequence
  Synthetic oligonucleotide
ttttccgaccagagccttgt

SEQ ID NO: 2462 - DNA, 20 bp, Artificial sequence
  Synthetic oligonucleotide
tttttccgaccagagccttg

SEQ ID NO: 2463 - DNA, 20 bp, Artificial sequence
  Synthetic oligonucleotide
agtagaagacagtaattttt

SEQ ID NO: 2464 - DNA, 20 bp, Artificial sequence
  Synthetic oligonucleotide
gagtagaagacagtaatttt

SEQ ID NO: 2465 - DNA, 20 bp, Artificial sequence
  Synthetic oligonucleotide
agagtagaagacagtaattt

SEQ ID NO: 2466 - DNA, 20 bp, Artificial sequence
  Synthetic oligonucleotide
tagagtagaagacagtaatt

SEQ ID NO: 2467 - DNA, 20 bp, Artificial sequence
  Synthetic oligonucleotide
ttagagtagaagacagtaat

SEQ ID NO: 2468 - DNA, 20 bp, Artificial sequence
  Synthetic oligonucleotide
attagagtagaagacagtaa

SEQ ID NO: 2469 - DNA, 20 bp, Artificial sequence
  Synthetic oligonucleotide
aattagagtagaagacagta

SEQ ID NO: 2470 - DNA, 20 bp, Artificial sequence
  Synthetic oligonucleotide
gaattagagtagaagacagt

SEQ ID NO: 2471 - DNA, 20 bp, Artificial sequence
  Synthetic oligonucleotide
ggaattagagtagaagacag

SEQ ID NO: 2472 - DNA, 20 bp, Artificial sequence
  Synthetic oligonucleotide
aggaattagagtagaagaca

SEQ ID NO: 2473 - DNA, 20 bp, Artificial sequence
  Synthetic oligonucleotide
gaggaattagagtagaagac

SEQ ID NO: 2474 - DNA, 20 bp, Artificial sequence
  Synthetic oligonucleotide
ggaggaattagagtagaaga

SEQ ID NO: 2475 - DNA, 20 bp, Artificial sequence
  Synthetic oligonucleotide
cggaggaattagagtagaag

SEQ ID NO: 2476 - DNA, 20 bp, Artificial sequence
  Synthetic oligonucleotide
gcggaggaattagagtagaa

SEQ ID NO: 2477 - DNA, 20 bp, Artificial sequence
  Synthetic oligonucleotide
agcggaggaattagagtaga

SEQ ID NO: 2478 - DNA, 20 bp, Artificial sequence
  Synthetic oligonucleotide
tagcggaggaattagagtag

SEQ ID NO: 2479 - DNA, 20 bp, Artificial sequence
  Synthetic oligonucleotide
ctagcggaggaattagagta

SEQ ID NO: 2480 - DNA, 20 bp, Artificial sequence
  Synthetic oligonucleotide
tctagcggaggaattagagt

SEQ ID NO: 2481 - DNA, 20 bp, Artificial sequence
  Synthetic oligonucleotide
tcactgttatctctagcgga

SEQ ID NO: 2482 - DNA, 20 bp, Artificial sequence
  Synthetic oligonucleotide
gtcactgttatctctagcgg

SEQ ID NO: 2483 - DNA, 20 bp, Artificial sequence
  Synthetic oligonucleotide
tgtcactgttatctctagcg

SEQ ID NO: 2484 - DNA, 20 bp, Artificial sequence
  Synthetic oligonucleotide
ctgtcactgttatctctagc

SEQ ID NO: 2485 - DNA, 20 bp, Artificial sequence
  Synthetic oligonucleotide
tctgtcactgttatctctag

SEQ ID NO: 2486 - DNA, 20 bp, Artificial sequence
  Synthetic oligonucleotide
ctctgtcactgttatctcta

SEQ ID NO: 2487 - DNA, 20 bp, Artificial sequence
  Synthetic oligonucleotide
cctctgtcactgttatctct

SEQ ID NO: 2488 - DNA, 20 bp, Artificial sequence
  Synthetic oligonucleotide
tcctctgtcactgttatctc

SEQ ID NO: 2489 - DNA, 20 bp, Artificial sequence
  Synthetic oligonucleotide
ttcctctgtcactgttatct

SEQ ID NO: 2490 - DNA, 20 bp, Artificial sequence
  Synthetic oligonucleotide
gttcctctgtcactgttatc

SEQ ID NO: 2491 - DNA, 20 bp, Artificial sequence
  Synthetic oligonucleotide
tgttcctctgtcactgttat

SEQ ID NO: 2492 - DNA, 20 bp, Artificial sequence
  Synthetic oligonucleotide
ttgttcctctgtcactgtta

SEQ ID NO: 2493 - DNA, 20 bp, Artificial sequence
  Synthetic oligonucleotide
tttgttcctctgtcactgtt

SEQ ID NO: 2494 - DNA, 20 bp, Artificial sequence
  Synthetic oligonucleotide
ctttgttcctctgtcactgt

SEQ ID NO: 2495 - DNA, 20 bp, Artificial sequence
  Synthetic oligonucleotide
cctttgttcctctgtcactg

SEQ ID NO: 2496 - DNA, 20 bp, Artificial sequence
  Synthetic oligonucleotide
tcctttgttcctctgtcact

SEQ ID NO: 2497 - DNA, 20 bp, Artificial sequence
  Synthetic oligonucleotide
ctcctttgttcctctgtcac

SEQ ID NO: 2498 - DNA, 20 bp, Artificial sequence
  Synthetic oligonucleotide
tctcctttgttcctctgtca

SEQ ID NO: 2499 - DNA, 20 bp, Artificial sequence
  Synthetic oligonucleotide
gtctcctttgttcctctgtc

SEQ ID NO: 2500 - DNA, 20 bp, Artificial sequence
  Synthetic oligonucleotide
agtctcctttgttcctctgt

SEQ ID NO: 2501 - DNA, 20 bp, Artificial sequence
  Synthetic oligonucleotide
gagtctcctttgttcctctg

SEQ ID NO: 2502 - DNA, 20 bp, Artificial sequence
  Synthetic oligonucleotide
agagtctcctttgttcctct

SEQ ID NO: 2503 - DNA, 20 bp, Artificial sequence
  Synthetic oligonucleotide
aagagtctcctttgttcctc

SEQ ID NO: 2504 - DNA, 20 bp, Artificial sequence
  Synthetic oligonucleotide
taagagtctcctttgttcct

SEQ ID NO: 2505 - DNA, 20 bp, Artificial sequence
  Synthetic oligonucleotide
ataagagtctcctttgttcc

SEQ ID NO: 2506 - DNA, 20 bp, Artificial sequence
  Synthetic oligonucleotide
cataagagtctcctttgttc

SEQ ID NO: 2507 - DNA, 20 bp, Artificial sequence
  Synthetic oligonucleotide
ccataagagtctcctttgtt

SEQ ID NO: 2508 - DNA, 20 bp, Artificial sequence
  Synthetic oligonucleotide
accataagagtctcctttgt

SEQ ID NO: 2509 - DNA, 20 bp, Artificial sequence
  Synthetic oligonucleotide
caccataagagtctcctttg

SEQ ID NO: 2510 - DNA, 20 bp, Artificial sequence
  Synthetic oligonucleotide
acaccataagagtctccttt

SEQ ID NO: 2511 - DNA, 20 bp, Artificial sequence
  Synthetic oligonucleotide
aacaccataagagtctcctt

SEQ ID NO: 2512 - DNA, 20 bp, Artificial sequence
  Synthetic oligonucleotide
taacaccataagagtctcct

SEQ ID NO: 2513 - DNA, 20 bp, Artificial sequence
  Synthetic oligonucleotide
gtaacaccataagagtctcc

SEQ ID NO: 2514 - DNA, 20 bp, Artificial sequence
  Synthetic oligonucleotide
ggtaacaccataagagtctc

SEQ ID NO: 2515 - DNA, 20 bp, Artificial sequence
  Synthetic oligonucleotide
ttccagatttttgtggtaac

SEQ ID NO: 2516 - DNA, 20 bp, Artificial sequence
  Synthetic oligonucleotide
cttccagatttttgtggtaa

SEQ ID NO: 2517 - DNA, 20 bp, Artificial sequence
  Synthetic oligonucleotide
tcttccagatttttgtggta

SEQ ID NO: 2518 - DNA, 20 bp, Artificial sequence
  Synthetic oligonucleotide
atcttccagatttttgtggt

SEQ ID NO: 2519 - DNA, 20 bp, Artificial sequence
  Synthetic oligonucleotide
gatcttccagatttttgtgg

SEQ ID NO: 2520 - DNA, 20 bp, Artificial sequence
  Synthetic oligonucleotide
agatcttccagatttttgtg

SEQ ID NO: 2521 - DNA, 20 bp, Artificial sequence
  Synthetic oligonucleotide
cagatcttccagatttttgt

SEQ ID NO: 2522 - DNA, 20 bp, Artificial sequence
  Synthetic oligonucleotide
ccagatcttccagatttttg

SEQ ID NO: 2523 - DNA, 20 bp, Artificial sequence
  Synthetic oligonucleotide
cccagatcttccagattttt

SEQ ID NO: 2524 - DNA, 20 bp, Artificial sequence
  Synthetic oligonucleotide
gcccagatcttccagatttt

SEQ ID NO: 2525 - DNA, 20 bp, Artificial sequence
  Synthetic oligonucleotide
ggcccagatcttccagattt

SEQ ID NO: 2526 - DNA, 20 bp, Artificial sequence
  Synthetic oligonucleotide
aggcccagatcttccagatt

SEQ ID NO: 2527 - DNA, 20 bp, Artificial sequence
  Synthetic oligonucleotide
aaggcccagatcttccagat

SEQ ID NO: 2528 - DNA, 20 bp, Artificial sequence
  Synthetic oligonucleotide
caaggcccagatcttccaga

SEQ ID NO: 2529 - DNA, 20 bp, Artificial sequence
  Synthetic oligonucleotide
tcaaggcccagatcttccag

SEQ ID NO: 2530 - DNA, 20 bp, Artificial sequence
  Synthetic oligonucleotide
ttcaaggcccagatcttcca

SEQ ID NO: 2531 - DNA, 20 bp, Artificial sequence
  Synthetic oligonucleotide
attcaaggcccagatcttcc

SEQ ID NO: 2532 - DNA, 20 bp, Artificial sequence
  Synthetic oligonucleotide
aattcaaggcccagatcttc

SEQ ID NO: 2533 - DNA, 20 bp, Artificial sequence
  Synthetic oligonucleotide
aaattcaaggcccagatctt

SEQ ID NO: 2534 - DNA, 20 bp, Artificial sequence
  Synthetic oligonucleotide
caaattcaaggcccagatct

SEQ ID NO: 2535 - DNA, 20 bp, Artificial sequence
  Synthetic oligonucleotide
acaaattcaaggcccagatc

SEQ ID NO: 2536 - DNA, 20 bp, Artificial sequence
  Synthetic oligonucleotide
tacaaattcaaggcccagat

SEQ ID NO: 2537 - DNA, 20 bp, Artificial sequence
  Synthetic oligonucleotide
atacaaattcaaggcccaga

SEQ ID NO: 2538 - DNA, 20 bp, Artificial sequence
  Synthetic oligonucleotide
aatacaaattcaaggcccag

SEQ ID NO: 2539 - DNA, 20 bp, Artificial sequence
  Synthetic oligonucleotide
aaatacaaattcaaggccca

SEQ ID NO: 2540 - DNA, 20 bp, Artificial sequence
  Synthetic oligonucleotide
gaaatacaaattcaaggccc

SEQ ID NO: 2541 - DNA, 20 bp, Artificial sequence
  Synthetic oligonucleotide
ggaaatacaaattcaaggcc

SEQ ID NO: 2542 - DNA, 20 bp, Artificial sequence
  Synthetic oligonucleotide
tggaaatacaaattcaaggc

SEQ ID NO: 2543 - DNA, 20 bp, Artificial sequence
  Synthetic oligonucleotide
ctggaaatacaaattcaagg

SEQ ID NO: 2544 - DNA, 20 bp, Artificial sequence
  Synthetic oligonucleotide
tctggaaatacaaattcaag

SEQ ID NO: 2545 - DNA, 20 bp, Artificial sequence
  Synthetic oligonucleotide
gtctggaaatacaaattcaa

SEQ ID NO: 2546 - DNA, 20 bp, Artificial sequence
  Synthetic oligonucleotide
tgtctggaaatacaaattca

SEQ ID NO: 2547 - DNA, 20 bp, Artificial sequence
  Synthetic oligonucleotide
gtgtctggaaatacaaattc

SEQ ID NO: 2548 - DNA, 20 bp, Artificial sequence
  Synthetic oligonucleotide
agtgtctggaaatacaaatt

SEQ ID NO: 2549 - DNA, 20 bp, Artificial sequence
  Synthetic oligonucleotide
tagtgtctggaaatacaaat

SEQ ID NO: 2550 - DNA, 20 bp, Artificial sequence
  Synthetic oligonucleotide
ctagtgtctggaaatacaaa

SEQ ID NO: 2551 - DNA, 20 bp, Artificial sequence
  Synthetic oligonucleotide
actagtgtctggaaatacaa

SEQ ID NO: 2552 - DNA, 20 bp, Artificial sequence
  Synthetic oligonucleotide
cactagtgtctggaaataca

SEQ ID NO: 2553 - DNA, 20 bp, Artificial sequence
  Synthetic oligonucleotide
tcactagtgtctggaaatac

SEQ ID NO: 2554 - DNA, 20 bp, Artificial sequence
  Synthetic oligonucleotide
atcactagtgtctggaaata

SEQ ID NO: 2555 - DNA, 20 bp, Artificial sequence
  Synthetic oligonucleotide
aatcactagtgtctggaaat

SEQ ID NO: 2556 - DNA, 20 bp, Artificial sequence
  Synthetic oligonucleotide
gaatcactagtgtctggaaa

SEQ ID NO: 2557 - DNA, 20 bp, Artificial sequence
  Synthetic oligonucleotide
agaatcactagtgtctggaa

SEQ ID NO: 2558 - DNA, 20 bp, Artificial sequence
  Synthetic oligonucleotide
gagaatcactagtgtctgga

SEQ ID NO: 2559 - DNA, 20 bp, Artificial sequence
  Synthetic oligonucleotide
agagaatcactagtgtctgg

SEQ ID NO: 2560 - DNA, 20 bp, Artificial sequence
  Synthetic oligonucleotide
cagagaatcactagtgtctg

SEQ ID NO: 2561 - DNA, 20 bp, Artificial sequence
  Synthetic oligonucleotide
ccagagaatcactagtgtct

SEQ ID NO: 2562 - DNA, 20 bp, Artificial sequence
  Synthetic oligonucleotide
accagagaatcactagtgtc

SEQ ID NO: 2563 - DNA, 20 bp, Artificial sequence
  Synthetic oligonucleotide
gaccagagaatcactagtgt

SEQ ID NO: 2564 - DNA, 20 bp, Artificial sequence
  Synthetic oligonucleotide
ggaccagagaatcactagtg

SEQ ID NO: 2565 - DNA, 20 bp, Artificial sequence
  Synthetic oligonucleotide
aggaccagagaatcactagt

SEQ ID NO: 2566 - DNA, 20 bp, Artificial sequence
  Synthetic oligonucleotide
aaggaccagagaatcactag

SEQ ID NO: 2567 - DNA, 20 bp, Artificial sequence
  Synthetic oligonucleotide
caaggaccagagaatcacta

SEQ ID NO: 2568 - DNA, 20 bp, Artificial sequence
  Synthetic oligonucleotide
acaaggaccagagaatcact

SEQ ID NO: 2569 - DNA, 20 bp, Artificial sequence
  Synthetic oligonucleotide
cacaaggaccagagaatcac

SEQ ID NO: 2570 - DNA, 20 bp, Artificial sequence
  Synthetic oligonucleotide
ccacaaggaccagagaatca

SEQ ID NO: 2571 - DNA, 20 bp, Artificial sequence
  Synthetic oligonucleotide
cccacaaggaccagagaatc

SEQ ID NO: 2572 - DNA, 20 bp, Artificial sequence
  Synthetic oligonucleotide
acatagtggtacttttccca

SEQ ID NO: 2573 - DNA, 20 bp, Artificial sequence
  Synthetic oligonucleotide
aacatagtggtacttttccc

SEQ ID NO: 2574 - DNA, 20 bp, Artificial sequence
  Synthetic oligonucleotide
aaacatagtggtacttttcc

SEQ ID NO: 2575 - DNA, 20 bp, Artificial sequence
  Synthetic oligonucleotide
aaaacatagtggtacttttc

SEQ ID NO: 2576 - DNA, 20 bp, Artificial sequence
  Synthetic oligonucleotide
caaaacatagtggtactttt

SEQ ID NO: 2577 - DNA, 20 bp, Artificial sequence
  Synthetic oligonucleotide
acaaaacatagtggtacttt

SEQ ID NO: 2578 - DNA, 20 bp, Artificial sequence
  Synthetic oligonucleotide
cacaaaacatagtggtactt

SEQ ID NO: 2579 - DNA, 20 bp, Artificial sequence
  Synthetic oligonucleotide
tctttccacaaaacatagtg

SEQ ID NO: 2580 - DNA, 20 bp, Artificial sequence
  Synthetic oligonucleotide
ctctttccacaaaacatagt

SEQ ID NO: 2581 - DNA, 20 bp, Artificial sequence
  Synthetic oligonucleotide
tctctttccacaaaacatag

SEQ ID NO: 2582 - DNA, 20 bp, Artificial sequence
  Synthetic oligonucleotide
ttctctttccacaaaacata

SEQ ID NO: 2583 - DNA, 20 bp, Artificial sequence
  Synthetic oligonucleotide
cttctctttccacaaaacat

SEQ ID NO: 2584 - DNA, 20 bp, Artificial sequence
  Synthetic oligonucleotide
gcttctctttccacaaaaca

SEQ ID NO: 2585 - DNA, 20 bp, Artificial sequence
  Synthetic oligonucleotide
ggcttctctttccacaaaac

SEQ ID NO: 2586 - DNA, 20 bp, Artificial sequence
  Synthetic oligonucleotide
tggcttctctttccacaaaa

SEQ ID NO: 2587 - DNA, 20 bp, Artificial sequence
  Synthetic oligonucleotide
ttggcttctctttccacaaa

SEQ ID NO: 2588 - DNA, 20 bp, Artificial sequence
  Synthetic oligonucleotide
attggcttctctttccacaa

SEQ ID NO: 2589 - DNA, 20 bp, Artificial sequence
  Synthetic oligonucleotide
cattggcttctctttccaca

SEQ ID NO: 2590 - DNA, 20 bp, Artificial sequence
  Synthetic oligonucleotide
tcattggcttctctttccac

SEQ ID NO: 2591 - DNA, 20 bp, Artificial sequence
  Synthetic oligonucleotide
ttcattggcttctctttcca

SEQ ID NO: 2592 - DNA, 20 bp, Artificial sequence
  Synthetic oligonucleotide
gttcattggcttctctttcc

SEQ ID NO: 2593 - DNA, 20 bp, Artificial sequence
  Synthetic oligonucleotide
agttcattggcttctctttc

SEQ ID NO: 2594 - DNA, 20 bp, Artificial sequence
  Synthetic oligonucleotide
aagttcattggcttctcttt

SEQ ID NO: 2595 - DNA, 20 bp, Artificial sequence
  Synthetic oligonucleotide
gaagttcattggcttctctt

SEQ ID NO: 2596 - DNA, 20 bp, Artificial sequence
  Synthetic oligonucleotide
tctccgaagttcattggctt

SEQ ID NO: 2597 - DNA, 20 bp, Artificial sequence
  Synthetic oligonucleotide
ctctccgaagttcattggct

SEQ ID NO: 2598 - DNA, 20 bp, Artificial sequence
  Synthetic oligonucleotide
cctctccgaagttcattggc

SEQ ID NO: 2599 - DNA, 20 bp, Artificial sequence
  Synthetic oligonucleotide
tcctctccgaagttcattgg

SEQ ID NO: 2600 - DNA, 20 bp, Artificial sequence
  Synthetic oligonucleotide
ttcctctccgaagttcattg

SEQ ID NO: 2601 - DNA, 20 bp, Artificial sequence
  Synthetic oligonucleotide
cttcctctccgaagttcatt

SEQ ID NO: 2602 - DNA, 20 bp, Artificial sequence
  Synthetic oligonucleotide
agtagatcttcctctccgaa

SEQ ID NO: 2603 - DNA, 20 bp, Artificial sequence
  Synthetic oligonucleotide
cagtagatcttcctctccga

SEQ ID NO: 2604 - DNA, 20 bp, Artificial sequence
  Synthetic oligonucleotide
acagtagatcttcctctccg

SEQ ID NO: 2605 - DNA, 20 bp, Artificial sequence
  Synthetic oligonucleotide
cacagtagatcttcctctcc

SEQ ID NO: 2606 - DNA, 20 bp, Artificial sequence
  Synthetic oligonucleotide
tcacagtagatcttcctctc

SEQ ID NO: 2607 - DNA, 20 bp, Artificial sequence
  Synthetic oligonucleotide
gtcacagtagatcttcctct

SEQ ID NO: 2608 - DNA, 20 bp, Artificial sequence
  Synthetic oligonucleotide
ggtcacagtagatcttcctc

SEQ ID NO: 2609 - DNA, 20 bp, Artificial sequence
  Synthetic oligonucleotide
tggtcacagtagatcttcct

SEQ ID NO: 2610 - DNA, 20 bp, Artificial sequence
  Synthetic oligonucleotide
ttggtcacagtagatcttcc

SEQ ID NO: 2611 - DNA, 20 bp, Artificial sequence
  Synthetic oligonucleotide
cttggtcacagtagatcttc

SEQ ID NO: 2612 - DNA, 20 bp, Artificial sequence
  Synthetic oligonucleotide
tcttggtcacagtagatctt

SEQ ID NO: 2613 - DNA, 20 bp, Artificial sequence
  Synthetic oligonucleotide
ctcttggtcacagtagatct

SEQ ID NO: 2614 - DNA, 20 bp, Artificial sequence
  Synthetic oligonucleotide
actcttggtcacagtagatc

SEQ ID NO: 2615 - DNA, 20 bp, Artificial sequence
  Synthetic oligonucleotide
tactcttggtcacagtagat

SEQ ID NO: 2616 - DNA, 20 bp, Artificial sequence
  Synthetic oligonucleotide
atactcttggtcacagtaga

SEQ ID NO: 2617 - DNA, 20 bp, Artificial sequence
  Synthetic oligonucleotide
aatactcttggtcacagtag

SEQ ID NO: 2618 - DNA, 20 bp, Artificial sequence
  Synthetic oligonucleotide
caatactcttggtcacagta

SEQ ID NO: 2619 - DNA, 20 bp, Artificial sequence
  Synthetic oligonucleotide
acaatactcttggtcacagt

SEQ ID NO: 2620 - DNA, 20 bp, Artificial sequence
  Synthetic oligonucleotide
cacaatactcttggtcacag

SEQ ID NO: 2621 - DNA, 20 bp, Artificial sequence
  Synthetic oligonucleotide
ccacaatactcttggtcaca

SEQ ID NO: 2622 - DNA, 20 bp, Artificial sequence
  Synthetic oligonucleotide
tccacaatactcttggtcac

SEQ ID NO: 2623 - DNA, 20 bp, Artificial sequence
  Synthetic oligonucleotide
ctccacaatactcttggtca

SEQ ID NO: 2624 - DNA, 20 bp, Artificial sequence
  Synthetic oligonucleotide
cctccacaatactcttggtc

SEQ ID NO: 2625 - DNA, 20 bp, Artificial sequence
  Synthetic oligonucleotide
tcctccacaatactcttggt

SEQ ID NO: 2626 - DNA, 20 bp, Artificial sequence
  Synthetic oligonucleotide
ttcctccacaatactcttgg

SEQ ID NO: 2627 - DNA, 20 bp, Artificial sequence
  Synthetic oligonucleotide
attcctccacaatactcttg

SEQ ID NO: 2628 - DNA, 20 bp, Artificial sequence
  Synthetic oligonucleotide
aattcctccacaatactctt

SEQ ID NO: 2629 - DNA, 20 bp, Artificial sequence
  Synthetic oligonucleotide
aaattcctccacaatactct

SEQ ID NO: 2630 - DNA, 20 bp, Artificial sequence
  Synthetic oligonucleotide
taaattcctccacaatactc

SEQ ID NO: 2631 - DNA, 20 bp, Artificial sequence
  Synthetic oligonucleotide
ataaattcctccacaatact

SEQ ID NO: 2632 - DNA, 20 bp, Artificial sequence
  Synthetic oligonucleotide
gataaattcctccacaatac

SEQ ID NO: 2633 - DNA, 20 bp, Artificial sequence
  Synthetic oligonucleotide
agttgttctcggataaattc

SEQ ID NO: 2634 - DNA, 20 bp, Artificial sequence
  Synthetic oligonucleotide
cagttgttctcggataaatt

SEQ ID NO: 2635 - DNA, 20 bp, Artificial sequence
  Synthetic oligonucleotide
ccagttgttctcggataaat

SEQ ID NO: 2636 - DNA, 20 bp, Artificial sequence
  Synthetic oligonucleotide
tccagttgttctcggataaa

SEQ ID NO: 2637 - DNA, 20 bp, Artificial sequence
  Synthetic oligonucleotide
ctccagttgttctcggataa

SEQ ID NO: 2638 - DNA, 20 bp, Artificial sequence
  Synthetic oligonucleotide
gctccagttgttctcggata

SEQ ID NO: 2639 - DNA, 20 bp, Artificial sequence
  Synthetic oligonucleotide
agctccagttgttctcggat

SEQ ID NO: 2640 - DNA, 20 bp, Artificial sequence
  Synthetic oligonucleotide
tagctccagttgttctcgga

SEQ ID NO: 2641 - DNA, 20 bp, Artificial sequence
  Synthetic oligonucleotide
gtagctccagttgttctcgg

SEQ ID NO: 2642 - DNA, 20 bp, Artificial sequence
  Synthetic oligonucleotide
agtagctccagttgttctcg

SEQ ID NO: 2643 - DNA, 20 bp, Artificial sequence
  Synthetic oligonucleotide
gagtagctccagttgttctc

SEQ ID NO: 2644 - DNA, 20 bp, Artificial sequence
  Synthetic oligonucleotide
caatgtcccttggatgcctc

SEQ ID NO: 2645 - DNA, 20 bp, Artificial sequence
  Synthetic oligonucleotide
gcaatgtcccttggatgcct

SEQ ID NO: 2646 - DNA, 20 bp, Artificial sequence
  Synthetic oligonucleotide
tggcaatgtcccttggatgc

SEQ ID NO: 2647 - DNA, 20 bp, Artificial sequence
  Synthetic oligonucleotide
gtggcaatgtcccttggatg

SEQ ID NO: 2648 - DNA, 20 bp, Artificial sequence
  Synthetic oligonucleotide
agtggcaatgtcccttggat

SEQ ID NO: 2649 - DNA, 20 bp, Artificial sequence
  Synthetic oligonucleotide
cagtggcaatgtcccttgga

SEQ ID NO: 2650 - DNA, 20 bp, Artificial sequence
  Synthetic oligonucleotide
tcagtggcaatgtcccttgg

SEQ ID NO: 2651 - DNA, 20 bp, Artificial sequence
  Synthetic oligonucleotide
gtcagtggcaatgtcccttg

SEQ ID NO: 2652 - DNA, 20 bp, Artificial sequence
  Synthetic oligonucleotide
agtcagtggcaatgtccctt

SEQ ID NO: 2653 - DNA, 20 bp, Artificial sequence
  Synthetic oligonucleotide
cagtcagtggcaatgtccct

SEQ ID NO: 2654 - DNA, 20 bp, Artificial sequence
  Synthetic oligonucleotide
acagtcagtggcaatgtccc

SEQ ID NO: 2655 - DNA, 20 bp, Artificial sequence
  Synthetic oligonucleotide
gacagtcagtggcaatgtcc

SEQ ID NO: 2656 - DNA, 20 bp, Artificial sequence
  Synthetic oligonucleotide
ggacagtcagtggcaatgtc

SEQ ID NO: 2657 - DNA, 20 bp, Artificial sequence
  Synthetic oligonucleotide
tggacagtcagtggcaatgt

SEQ ID NO: 2658 - DNA, 20 bp, Artificial sequence
  Synthetic oligonucleotide
ctggacagtcagtggcaatg

SEQ ID NO: 2659 - DNA, 20 bp, Artificial sequence
  Synthetic oligonucleotide
tctggacagtcagtggcaat

SEQ ID NO: 2660 - DNA, 20 bp, Artificial sequence
  Synthetic oligonucleotide
ttctggacagtcagtggcaa

SEQ ID NO: 2661 - DNA, 20 bp, Artificial sequence
  Synthetic oligonucleotide
cttctggacagtcagtggca

SEQ ID NO: 2662 - DNA, 20 bp, Artificial sequence
  Synthetic oligonucleotide
accttctggacagtcagtgg

SEQ ID NO: 2663 - DNA, 20 bp, Artificial sequence
  Synthetic oligonucleotide
caccttctggacagtcagtg

SEQ ID NO: 2664 - DNA, 20 bp, Artificial sequence
  Synthetic oligonucleotide
acaccttctggacagtcagt

SEQ ID NO: 2665 - DNA, 20 bp, Artificial sequence
  Synthetic oligonucleotide
ccaacaccttctggacagtc

SEQ ID NO: 2666 - DNA, 20 bp, Artificial sequence
  Synthetic oligonucleotide
gccaacaccttctggacagt

SEQ ID NO: 2667 - DNA, 20 bp, Artificial sequence
  Synthetic oligonucleotide
tgccaacaccttctggacag

SEQ ID NO: 2668 - DNA, 20 bp, Artificial sequence
  Synthetic oligonucleotide
atgccaacaccttctggaca

SEQ ID NO: 2669 - DNA, 20 bp, Artificial sequence
  Synthetic oligonucleotide
gatgccaacaccttctggac

SEQ ID NO: 2670 - DNA, 20 bp, Artificial sequence
  Synthetic oligonucleotide
ggatgccaacaccttctgga

SEQ ID NO: 2671 - DNA, 20 bp, Artificial sequence
  Synthetic oligonucleotide
tgggatgccaacaccttctg

SEQ ID NO: 2672 - DNA, 20 bp, Artificial sequence
  Synthetic oligonucleotide
ttgggatgccaacaccttct

SEQ ID NO: 2673 - DNA, 20 bp, Artificial sequence
  Synthetic oligonucleotide
cttgggatgccaacaccttc

SEQ ID NO: 2674 - DNA, 20 bp, Artificial sequence
  Synthetic oligonucleotide
gcttgggatgccaacacctt

SEQ ID NO: 2675 - DNA, 20 bp, Artificial sequence
  Synthetic oligonucleotide
taaacttaatggccccatgg

SEQ ID NO: 2676 - DNA, 20 bp, Artificial sequence
  Synthetic oligonucleotide
ttaaacttaatggccccatg

SEQ ID NO: 2677 - DNA, 20 bp, Artificial sequence
  Synthetic oligonucleotide
aggccatcattaaacttaat

SEQ ID NO: 2678 - DNA, 20 bp, Artificial sequence
  Synthetic oligonucleotide
caggccatcattaaacttaa

SEQ ID NO: 2679 - DNA, 20 bp, Artificial sequence
  Synthetic oligonucleotide
tcaggccatcattaaactta

SEQ ID NO: 2680 - DNA, 20 bp, Artificial sequence
  Synthetic oligonucleotide
ctcaggccatcattaaactt

SEQ ID NO: 2681 - DNA, 20 bp, Artificial sequence
  Synthetic oligonucleotide
gctcaggccatcattaaact

SEQ ID NO: 2682 - DNA, 20 bp, Artificial sequence
  Synthetic oligonucleotide
caactttcctgtaagctcag

SEQ ID NO: 2683 - DNA, 20 bp, Artificial sequence
  Synthetic oligonucleotide
gcaactttcctgtaagctca

SEQ ID NO: 2684 - DNA, 20 bp, Artificial sequence
  Synthetic oligonucleotide
ggcaactttcctgtaagctc

SEQ ID NO: 2685 - DNA, 20 bp, Artificial sequence
  Synthetic oligonucleotide
cggcaactttcctgtaagct

SEQ ID NO: 2686 - DNA, 20 bp, Artificial sequence
  Synthetic oligonucleotide
gcggcaactttcctgtaagc

SEQ ID NO: 2687 - DNA, 20 bp, Artificial sequence
  Synthetic oligonucleotide
ggcggcaactttcctgtaag

SEQ ID NO: 2688 - DNA, 20 bp, Artificial sequence
  Synthetic oligonucleotide
aggcggcaactttcctgtaa

SEQ ID NO: 2689 - DNA, 20 bp, Artificial sequence
  Synthetic oligonucleotide
aaggcggcaactttcctgta

SEQ ID NO: 2690 - DNA, 20 bp, Artificial sequence
  Synthetic oligonucleotide
taaggcggcaactttcctgt

SEQ ID NO: 2691 - DNA, 20 bp, Artificial sequence
  Synthetic oligonucleotide
ataaggcggcaactttcctg

SEQ ID NO: 2692 - DNA, 20 bp, Artificial sequence
  Synthetic oligonucleotide
aataaggcggcaactttcct

SEQ ID NO: 2693 - DNA, 20 bp, Artificial sequence
  Synthetic oligonucleotide
caataaggcggcaactttcc

SEQ ID NO: 2694 - DNA, 20 bp, Artificial sequence
  Synthetic oligonucleotide
tcaataaggcggcaactttc

SEQ ID NO: 2695 - DNA, 20 bp, Artificial sequence
  Synthetic oligonucleotide
ttcaataaggcggcaacttt

SEQ ID NO: 2696 - DNA, 20 bp, Artificial sequence
  Synthetic oligonucleotide
cttcaataaggcggcaactt

SEQ ID NO: 2697 - DNA, 20 bp, Artificial sequence
  Synthetic oligonucleotide
gcttcaataaggcggcaact

SEQ ID NO: 2698 - DNA, 20 bp, Artificial sequence
  Synthetic oligonucleotide
agcttcaataaggcggcaac

SEQ ID NO: 2699 - DNA, 20 bp, Artificial sequence
  Synthetic oligonucleotide
gagcttcaataaggcggcaa

SEQ ID NO: 2700 - DNA, 20 bp, Artificial sequence
  Synthetic oligonucleotide
agagcttcaataaggcggca

SEQ ID NO: 2701 - DNA, 20 bp, Artificial sequence
  Synthetic oligonucleotide
cagagcttcaataaggcggc

SEQ ID NO: 2702 - DNA, 20 bp, Artificial sequence
  Synthetic oligonucleotide
acagagcttcaataaggcgg

SEQ ID NO: 2703 - DNA, 20 bp, Artificial sequence
  Synthetic oligonucleotide
gacagagcttcaataaggcg

SEQ ID NO: 2704 - DNA, 20 bp, Artificial sequence
  Synthetic oligonucleotide
ggacagagcttcaataaggc

SEQ ID NO: 2705 - DNA, 20 bp, Artificial sequence
  Synthetic oligonucleotide
aggacagagcttcaataagg

SEQ ID NO: 2706 - DNA, 20 bp, Artificial sequence
  Synthetic oligonucleotide
gaggacagagcttcaataag

SEQ ID NO: 2707 - DNA, 20 bp, Artificial sequence
  Synthetic oligonucleotide
tgaggacagagcttcaataa

SEQ ID NO: 2708 - DNA, 20 bp, Artificial sequence
  Synthetic oligonucleotide
atgaggacagagcttcaata

SEQ ID NO: 2709 - DNA, 20 bp, Artificial sequence
  Synthetic oligonucleotide
catgaggacagagcttcaat

SEQ ID NO: 2710 - DNA, 20 bp, Artificial sequence
  Synthetic oligonucleotide
gcatgaggacagagcttcaa

SEQ ID NO: 2711 - DNA, 20 bp, Artificial sequence
  Synthetic oligonucleotide
ggcatgaggacagagcttca

SEQ ID NO: 2712 - DNA, 20 bp, Artificial sequence
  Synthetic oligonucleotide
tggcatgaggacagagcttc

SEQ ID NO: 2713 - DNA, 20 bp, Artificial sequence
  Synthetic oligonucleotide
agcacactggaatggcagct

SEQ ID NO: 2714 - DNA, 20 bp, Artificial sequence
  Synthetic oligonucleotide
tgagcacactggaatggcag

SEQ ID NO: 2715 - DNA, 20 bp, Artificial sequence
  Synthetic oligonucleotide
gcatagaaggtctcccgtga

SEQ ID NO: 2716 - DNA, 20 bp, Artificial sequence
  Synthetic oligonucleotide
agcatagaaggtctcccgtg

SEQ ID NO: 2717 - DNA, 20 bp, Artificial sequence
  Synthetic oligonucleotide
cagcatagaaggtctcccgt

SEQ ID NO: 2718 - DNA, 20 bp, Artificial sequence
  Synthetic oligonucleotide
acggcagcatagaaggtctc

SEQ ID NO: 2719 - DNA, 20 bp, Artificial sequence
  Synthetic oligonucleotide
aacggcagcatagaaggtct

SEQ ID NO: 2720 - DNA, 20 bp, Artificial sequence
  Synthetic oligonucleotide
taacggcagcatagaaggtc

SEQ ID NO: 2721 - DNA, 20 bp, Artificial sequence
  Synthetic oligonucleotide
ctaacggcagcatagaaggt

SEQ ID NO: 2722 - DNA, 20 bp, Artificial sequence
  Synthetic oligonucleotide
tggtctatgtcagctaacgg

SEQ ID NO: 2723 - DNA, 20 bp, Artificial sequence
  Synthetic oligonucleotide
gtggtctatgtcagctaacg

SEQ ID NO: 2724 - DNA, 20 bp, Artificial sequence
  Synthetic oligonucleotide
agtggtctatgtcagctaac

SEQ ID NO: 2725 - DNA, 20 bp, Artificial sequence
  Synthetic oligonucleotide
aagtggtctatgtcagctaa

SEQ ID NO: 2726 - DNA, 20 bp, Artificial sequence
  Synthetic oligonucleotide
caagtggtctatgtcagcta

SEQ ID NO: 2727 - DNA, 20 bp, Artificial sequence
  Synthetic oligonucleotide
ccaagtggtctatgtcagct

SEQ ID NO: 2728 - DNA, 20 bp, Artificial sequence
  Synthetic oligonucleotide
tccaagtggtctatgtcagc

SEQ ID NO: 2729 - DNA, 20 bp, Artificial sequence
  Synthetic oligonucleotide
ttccaagtggtctatgtcag

SEQ ID NO: 2730 - DNA, 20 bp, Artificial sequence
  Synthetic oligonucleotide
gttccaagtggtctatgtca

SEQ ID NO: 2731 - DNA, 20 bp, Artificial sequence
  Synthetic oligonucleotide
tgttccaagtggtctatgtc

SEQ ID NO: 2732 - DNA, 20 bp, Artificial sequence
  Synthetic oligonucleotide
ctgttccaagtggtctatgt

SEQ ID NO: 2733 - DNA, 20 bp, Artificial sequence
  Synthetic oligonucleotide
cctgttccaagtggtctatg

SEQ ID NO: 2734 - DNA, 20 bp, Artificial sequence
  Synthetic oligonucleotide
tcctgttccaagtggtctat

SEQ ID NO: 2735 - DNA, 20 bp, Artificial sequence
  Synthetic oligonucleotide
ttcctgttccaagtggtcta

SEQ ID NO: 2736 - DNA, 20 bp, Artificial sequence
  Synthetic oligonucleotide
tttcctgttccaagtggtct

SEQ ID NO: 2737 - DNA, 20 bp, Artificial sequence
  Synthetic oligonucleotide
ttttcctgttccaagtggtc

SEQ ID NO: 2738 - DNA, 20 bp, Artificial sequence
  Synthetic oligonucleotide
tttttcctgttccaagtggt

SEQ ID NO: 2739 - DNA, 20 bp, Artificial sequence
  Synthetic oligonucleotide
gtttttcctgttccaagtgg

SEQ ID NO: 2740 - DNA, 20 bp, Artificial sequence
  Synthetic oligonucleotide
tgtttttcctgttccaagtg

SEQ ID NO: 2741 - DNA, 20 bp, Artificial sequence
  Synthetic oligonucleotide
ctgtttttcctgttccaagt

SEQ ID NO: 2742 - DNA, 20 bp, Artificial sequence
  Synthetic oligonucleotide
tctgtttttcctgttccaag

SEQ ID NO: 2743 - DNA, 20 bp, Artificial sequence
  Synthetic oligonucleotide
atctgtttttcctgttccaa

SEQ ID NO: 2744 - DNA, 20 bp, Artificial sequence
  Synthetic oligonucleotide
aatctgtttttcctgttcca

SEQ ID NO: 2745 - DNA, 20 bp, Artificial sequence
  Synthetic oligonucleotide
taatctgtttttcctgttcc

SEQ ID NO: 2746 - DNA, 20 bp, Artificial sequence
  Synthetic oligonucleotide
ttaatctgtttttcctgttc

SEQ ID NO: 2747 - DNA, 20 bp, Artificial sequence
  Synthetic oligonucleotide
tttaatctgtttttcctgtt

SEQ ID NO: 2748 - DNA, 20 bp, Artificial sequence
  Synthetic oligonucleotide
gtttaatctgtttttcctgt

SEQ ID NO: 2749 - DNA, 20 bp, Artificial sequence
  Synthetic oligonucleotide
ggtttaatctgtttttcctg

SEQ ID NO: 2750 - DNA, 20 bp, Artificial sequence
  Synthetic oligonucleotide
gggtttaatctgtttttcct

SEQ ID NO: 2751 - DNA, 20 bp, Artificial sequence
  Synthetic oligonucleotide
tgggtttaatctgtttttcc

SEQ ID NO: 2752 - DNA, 20 bp, Artificial sequence
  Synthetic oligonucleotide
ttgggtttaatctgtttttc

SEQ ID NO: 2753 - DNA, 20 bp, Artificial sequence
  Synthetic oligonucleotide
gttgggtttaatctgttttt

SEQ ID NO: 2754 - DNA, 20 bp, Artificial sequence
  Synthetic oligonucleotide
ggttgggtttaatctgtttt

SEQ ID NO: 2755 - DNA, 20 bp, Artificial sequence
  Synthetic oligonucleotide
aggttgggtttaatctgttt

SEQ ID NO: 2756 - DNA, 20 bp, Artificial sequence
  Synthetic oligonucleotide
gaggttgggtttaatctgtt

SEQ ID NO: 2757 - DNA, 20 bp, Artificial sequence
  Synthetic oligonucleotide
tgaggttgggtttaatctgt

SEQ ID NO: 2758 - DNA, 20 bp, Artificial sequence
  Synthetic oligonucleotide
gtgaggttgggtttaatctg

SEQ ID NO: 2759 - DNA, 20 bp, Artificial sequence
  Synthetic oligonucleotide
agtgaggttgggtttaatct

SEQ ID NO: 2760 - DNA, 20 bp, Artificial sequence
  Synthetic oligonucleotide
tagtgaggttgggtttaatc

SEQ ID NO: 2761 - DNA, 20 bp, Artificial sequence
  Synthetic oligonucleotide
ttagtgaggttgggtttaat

SEQ ID NO: 2762 - DNA, 20 bp, Artificial sequence
  Synthetic oligonucleotide
tttagtgaggttgggtttaa

SEQ ID NO: 2763 - DNA, 20 bp, Artificial sequence
  Synthetic oligonucleotide
gtttagtgaggttgggttta

SEQ ID NO: 2764 - DNA, 20 bp, Artificial sequence
  Synthetic oligonucleotide
agtttagtgaggttgggttt

SEQ ID NO: 2765 - DNA, 20 bp, Artificial sequence
  Synthetic oligonucleotide
aagtttagtgaggttgggtt

SEQ ID NO: 2766 - DNA, 20 bp, Artificial sequence
  Synthetic oligonucleotide
gaagtttagtgaggttgggt

SEQ ID NO: 2767 - DNA, 20 bp, Artificial sequence
  Synthetic oligonucleotide
cgaagtttagtgaggttggg

SEQ ID NO: 2768 - DNA, 20 bp, Artificial sequence
  Synthetic oligonucleotide
gcgaagtttagtgaggttgg

SEQ ID NO: 2769 - DNA, 20 bp, Artificial sequence
  Synthetic oligonucleotide
tgcgaagtttagtgaggttg

SEQ ID NO: 2770 - DNA, 20 bp, Artificial sequence
  Synthetic oligonucleotide
ttgcgaagtttagtgaggtt

SEQ ID NO: 2771 - DNA, 20 bp, Artificial sequence
  Synthetic oligonucleotide
tttgcgaagtttagtgaggt

SEQ ID NO: 2772 - DNA, 20 bp, Artificial sequence
  Synthetic oligonucleotide
ttttgcgaagtttagtgagg

SEQ ID NO: 2773 - DNA, 20 bp, Artificial sequence
  Synthetic oligonucleotide
attttgcgaagtttagtgag

SEQ ID NO: 2774 - DNA, 20 bp, Artificial sequence
  Synthetic oligonucleotide
cattttgcgaagtttagtga

SEQ ID NO: 2775 - DNA, 20 bp, Artificial sequence
  Synthetic oligonucleotide
ccattttgcgaagtttagtg

SEQ ID NO: 2776 - DNA, 20 bp, Artificial sequence
  Synthetic oligonucleotide
gccattttgcgaagtttagt

SEQ ID NO: 2777 - DNA, 20 bp, Artificial sequence
  Synthetic oligonucleotide
ggccattttgcgaagtttag

SEQ ID NO: 2778 - DNA, 20 bp, Artificial sequence
  Synthetic oligonucleotide
gggccattttgcgaagttta

SEQ ID NO: 2779 - DNA, 20 bp, Artificial sequence
  Synthetic oligonucleotide
tgggccattttgcgaagttt

SEQ ID NO: 2780 - DNA, 20 bp, Artificial sequence
  Synthetic oligonucleotide
ctgggccattttgcgaagtt

SEQ ID NO: 2781 - DNA, 20 bp, Artificial sequence
  Synthetic oligonucleotide
cctgggccattttgcgaagt

SEQ ID NO: 2782 - DNA, 20 bp, Artificial sequence
  Synthetic oligonucleotide
tttccaaagagacgccaggc

SEQ ID NO: 2783 - DNA, 20 bp, Artificial sequence
  Synthetic oligonucleotide
ttttccaaagagacgccagg

SEQ ID NO: 2784 - DNA, 20 bp, Artificial sequence
  Synthetic oligonucleotide
cttttccaaagagacgccag

SEQ ID NO: 2785 - DNA, 20 bp, Artificial sequence
  Synthetic oligonucleotide
gcttttccaaagagacgcca

SEQ ID NO: 2786 - DNA, 20 bp, Artificial sequence
  Synthetic oligonucleotide
tgcttttccaaagagacgcc

SEQ ID NO: 2787 - DNA, 20 bp, Artificial sequence
  Synthetic oligonucleotide
ctgcttttccaaagagacgc

SEQ ID NO: 2788 - DNA, 20 bp, Artificial sequence
  Synthetic oligonucleotide
tctgcttttccaaagagacg

SEQ ID NO: 2789 - DNA, 20 bp, Artificial sequence
  Synthetic oligonucleotide
ctctgcttttccaaagagac

SEQ ID NO: 2790 - DNA, 20 bp, Artificial sequence
  Synthetic oligonucleotide
actctgcttttccaaagaga

SEQ ID NO: 2791 - DNA, 20 bp, Artificial sequence
  Synthetic oligonucleotide
acactctgcttttccaaaga

SEQ ID NO: 2792 - DNA, 20 bp, Artificial sequence
  Synthetic oligonucleotide
cacactctgcttttccaaag

SEQ ID NO: 2793 - DNA, 20 bp, Artificial sequence
  Synthetic oligonucleotide
tcacactctgcttttccaaa

SEQ ID NO: 2794 - DNA, 20 bp, Artificial sequence
  Synthetic oligonucleotide
atcacactctgcttttccaa

SEQ ID NO: 2795 - DNA, 20 bp, Artificial sequence
  Synthetic oligonucleotide
tatcacactctgcttttcca

SEQ ID NO: 2796 - DNA, 20 bp, Artificial sequence
  Synthetic oligonucleotide
gtatcacactctgcttttcc

SEQ ID NO: 2797 - DNA, 20 bp, Artificial sequence
  Synthetic oligonucleotide
tgtatcacactctgcttttc

SEQ ID NO: 2798 - DNA, 20 bp, Artificial sequence
  Synthetic oligonucleotide
ttgtatcacactctgctttt

SEQ ID NO: 2799 - DNA, 20 bp, Artificial sequence
  Synthetic oligonucleotide
cttgtatcacactctgcttt

SEQ ID NO: 2800 - DNA, 20 bp, Artificial sequence
  Synthetic oligonucleotide
ccttgtatcacactctgctt

SEQ ID NO: 2801 - DNA, 20 bp, Artificial sequence
  Synthetic oligonucleotide
gccttgtatcacactctgct

SEQ ID NO: 2802 - DNA, 20 bp, Artificial sequence
  Synthetic oligonucleotide
tgccttgtatcacactctgc

SEQ ID NO: 2803 - DNA, 20 bp, Artificial sequence
  Synthetic oligonucleotide
ctgccttgtatcacactctg

SEQ ID NO: 2804 - DNA, 20 bp, Artificial sequence
  Synthetic oligonucleotide
tctgccttgtatcacactct

SEQ ID NO: 2805 - DNA, 20 bp, Artificial sequence
  Synthetic oligonucleotide
ctctgccttgtatcacactc

SEQ ID NO: 2806 - DNA, 20 bp, Artificial sequence
  Synthetic oligonucleotide
gctctgccttgtatcacact

SEQ ID NO: 2807 - DNA, 20 bp, Artificial sequence
  Synthetic oligonucleotide
tcacagggaggcatggattg

SEQ ID NO: 2808 - DNA, 20 bp, Artificial sequence
  Synthetic oligonucleotide
ttctcatggtggctcacagg

SEQ ID NO: 2809 - DNA, 20 bp, Artificial sequence
  Synthetic oligonucleotide
gttctcatggtggctcacag

SEQ ID NO: 2810 - DNA, 20 bp, Artificial sequence
  Synthetic oligonucleotide
tgttctcatggtggctcaca

SEQ ID NO: 2811 - DNA, 20 bp, Artificial sequence
  Synthetic oligonucleotide
ctgttctcatggtggctcac

SEQ ID NO: 2812 - DNA, 20 bp, Artificial sequence
  Synthetic oligonucleotide
tctgttctcatggtggctca

SEQ ID NO: 2813 - DNA, 20 bp, Artificial sequence
  Synthetic oligonucleotide
ttctgttctcatggtggctc

SEQ ID NO: 2814 - DNA, 20 bp, Artificial sequence
  Synthetic oligonucleotide
attctgttctcatggtggct

SEQ ID NO: 2815 - DNA, 20 bp, Artificial sequence
  Synthetic oligonucleotide
gattctgttctcatggtggc

SEQ ID NO: 2816 - DNA, 20 bp, Artificial sequence
  Synthetic oligonucleotide
tgattctgttctcatggtgg

SEQ ID NO: 2817 - DNA, 20 bp, Artificial sequence
  Synthetic oligonucleotide
gtgattctgttctcatggtg

SEQ ID NO: 2818 - DNA, 20 bp, Artificial sequence
  Synthetic oligonucleotide
agtgattctgttctcatggt

SEQ ID NO: 2819 - DNA, 20 bp, Artificial sequence
  Synthetic oligonucleotide
agaccagtgattctgttctc

SEQ ID NO: 2820 - DNA, 20 bp, Artificial sequence
  Synthetic oligonucleotide
ccttttagaccagtgattct

SEQ ID NO: 2821 - DNA, 20 bp, Artificial sequence
  Synthetic oligonucleotide
tccttttagaccagtgattc

SEQ ID NO: 2822 - DNA, 20 bp, Artificial sequence
  Synthetic oligonucleotide
ttccttttagaccagtgatt

SEQ ID NO: 2823 - DNA, 20 bp, Artificial sequence
  Synthetic oligonucleotide
gttccttttagaccagtgat

SEQ ID NO: 2824 - DNA, 20 bp, Artificial sequence
  Synthetic oligonucleotide
tgttccttttagaccagtga

SEQ ID NO: 2825 - DNA, 20 bp, Artificial sequence
  Synthetic oligonucleotide
ttgttccttttagaccagtg

SEQ ID NO: 2826 - DNA, 20 bp, Artificial sequence
  Synthetic oligonucleotide
tttgttccttttagaccagt

SEQ ID NO: 2827 - DNA, 20 bp, Artificial sequence
  Synthetic oligonucleotide
ctttgttccttttagaccag

SEQ ID NO: 2828 - DNA, 20 bp, Artificial sequence
  Synthetic oligonucleotide
cctttgttccttttagacca

SEQ ID NO: 2829 - DNA, 20 bp, Artificial sequence
  Synthetic oligonucleotide
ccctttgttccttttagacc

SEQ ID NO: 2830 - DNA, 20 bp, Artificial sequence
  Synthetic oligonucleotide
tccctttgttccttttagac

SEQ ID NO: 2831 - DNA, 20 bp, Artificial sequence
  Synthetic oligonucleotide
atccctttgttccttttaga

SEQ ID NO: 2832 - DNA, 20 bp, Artificial sequence
  Synthetic oligonucleotide
catccctttgttccttttag

SEQ ID NO: 2833 - DNA, 20 bp, Artificial sequence
  Synthetic oligonucleotide
acatccctttgttcctttta

SEQ ID NO: 2834 - DNA, 20 bp, Artificial sequence
  Synthetic oligonucleotide
aacatccctttgttcctttt

SEQ ID NO: 2835 - DNA, 20 bp, Artificial sequence
  Synthetic oligonucleotide
tacagtgaacatccctttgt

SEQ ID NO: 2836 - DNA, 20 bp, Artificial sequence
  Synthetic oligonucleotide
atacagtgaacatccctttg

SEQ ID NO: 2837 - DNA, 20 bp, Artificial sequence
  Synthetic oligonucleotide
catacagtgaacatcccttt

SEQ ID NO: 2838 - DNA, 20 bp, Artificial sequence
  Synthetic oligonucleotide
gcatacagtgaacatccctt

SEQ ID NO: 2839 - DNA, 20 bp, Artificial sequence
  Synthetic oligonucleotide
ggcatacagtgaacatccct

SEQ ID NO: 2840 - DNA, 20 bp, Artificial sequence
  Synthetic oligonucleotide
aggcatacagtgaacatccc

SEQ ID NO: 2841 - DNA, 20 bp, Artificial sequence
  Synthetic oligonucleotide
gaggcatacagtgaacatcc

SEQ ID NO: 2842 - DNA, 20 bp, Artificial sequence
  Synthetic oligonucleotide
agaggcatacagtgaacatc

SEQ ID NO: 2843 - DNA, 20 bp, Artificial sequence
  Synthetic oligonucleotide
cagaggcatacagtgaacat

SEQ ID NO: 2844 - DNA, 20 bp, Artificial sequence
  Synthetic oligonucleotide
tcagaggcatacagtgaaca

SEQ ID NO: 2845 - DNA, 20 bp, Artificial sequence
  Synthetic oligonucleotide
ctcagaggcatacagtgaac

SEQ ID NO: 2846 - DNA, 20 bp, Artificial sequence
  Synthetic oligonucleotide
gctcagaggcatacagtgaa

SEQ ID NO: 2847 - DNA, 20 bp, Artificial sequence
  Synthetic oligonucleotide
tgctcagaggcatacagtga

SEQ ID NO: 2848 - DNA, 20 bp, Artificial sequence
  Synthetic oligonucleotide
agggacactgggctgattca

SEQ ID NO: 2849 - DNA, 20 bp, Artificial sequence
  Synthetic oligonucleotide
ctaagctgctcagggacact

SEQ ID NO: 2850 - DNA, 20 bp, Artificial sequence
  Synthetic oligonucleotide
tctaagctgctcagggacac

SEQ ID NO: 2851 - DNA, 20 bp, Artificial sequence
  Synthetic oligonucleotide
gtctaagctgctcagggaca

SEQ ID NO: 2852 - DNA, 20 bp, Artificial sequence
  Synthetic oligonucleotide
tgtctaagctgctcagggac

SEQ ID NO: 2853 - DNA, 20 bp, Artificial sequence
  Synthetic oligonucleotide
ctgtctaagctgctcaggga

SEQ ID NO: 2854 - DNA, 20 bp, Artificial sequence
  Synthetic oligonucleotide
tgatacagagagccctgctg

SEQ ID NO: 2855 - DNA, 20 bp, Artificial sequence
  Synthetic oligonucleotide
ctgatacagagagccctgct

SEQ ID NO: 2856 - DNA, 20 bp, Artificial sequence
  Synthetic oligonucleotide
actgatacagagagccctgc

SEQ ID NO: 2857 - DNA, 20 bp, Artificial sequence
  Synthetic oligonucleotide
agactgatacagagagccct

SEQ ID NO: 2858 - DNA, 20 bp, Artificial sequence
  Synthetic oligonucleotide
aagactgatacagagagccc

SEQ ID NO: 2859 - DNA, 20 bp, Artificial sequence
  Synthetic oligonucleotide
aaagactgatacagagagcc

SEQ ID NO: 2860 - DNA, 20 bp, Artificial sequence
  Synthetic oligonucleotide
gaaagactgatacagagagc

SEQ ID NO: 2861 - DNA, 20 bp, Artificial sequence
  Synthetic oligonucleotide
agaaagactgatacagagag

SEQ ID NO: 2862 - DNA, 20 bp, Artificial sequence
  Synthetic oligonucleotide
aagaaagactgatacagaga

SEQ ID NO: 2863 - DNA, 20 bp, Artificial sequence
  Synthetic oligonucleotide
caagaaagactgatacagag

SEQ ID NO: 2864 - DNA, 20 bp, Artificial sequence
  Synthetic oligonucleotide
tcaagaaagactgatacaga

SEQ ID NO: 2865 - DNA, 20 bp, Artificial sequence
  Synthetic oligonucleotide
gctcaagaaagactgataca

SEQ ID NO: 2866 - DNA, 20 bp, Artificial sequence
  Synthetic oligonucleotide
tgctcaagaaagactgatac

SEQ ID NO: 2867 - DNA, 20 bp, Artificial sequence
  Synthetic oligonucleotide
ctgctcaagaaagactgata

SEQ ID NO: 2868 - DNA, 20 bp, Artificial sequence
  Synthetic oligonucleotide
tctgctcaagaaagactgat

SEQ ID NO: 2869 - DNA, 20 bp, Artificial sequence
  Synthetic oligonucleotide
atctgctcaagaaagactga

SEQ ID NO: 2870 - DNA, 20 bp, Artificial sequence
  Synthetic oligonucleotide
catctgctcaagaaagactg

SEQ ID NO: 2871 - DNA, 20 bp, Artificial sequence
  Synthetic oligonucleotide
tcatctgctcaagaaagact

SEQ ID NO: 2872 - DNA, 20 bp, Artificial sequence
  Synthetic oligonucleotide
atcatctgctcaagaaagac

SEQ ID NO: 2873 - DNA, 20 bp, Artificial sequence
  Synthetic oligonucleotide
aatcatctgctcaagaaaga

SEQ ID NO: 2874 - DNA, 20 bp, Artificial sequence
  Synthetic oligonucleotide
gaatcatctgctcaagaaag

SEQ ID NO: 2875 - DNA, 20 bp, Artificial sequence
  Synthetic oligonucleotide
ggaatcatctgctcaagaaa

SEQ ID NO: 2876 - DNA, 20 bp, Artificial sequence
  Synthetic oligonucleotide
gggaatcatctgctcaagaa

SEQ ID NO: 2877 - DNA, 20 bp, Artificial sequence
  Synthetic oligonucleotide
atctggctactcaactaggg

SEQ ID NO: 2878 - DNA, 20 bp, Artificial sequence
  Synthetic oligonucleotide
catctggctactcaactagg

SEQ ID NO: 2879 - DNA, 20 bp, Artificial sequence
  Synthetic oligonucleotide
tcatctggctactcaactag

SEQ ID NO: 2880 - DNA, 20 bp, Artificial sequence
  Synthetic oligonucleotide
ttcatctggctactcaacta

SEQ ID NO: 2881 - DNA, 20 bp, Artificial sequence
  Synthetic oligonucleotide
tttcatctggctactcaact

SEQ ID NO: 2882 - DNA, 20 bp, Artificial sequence
  Synthetic oligonucleotide
atttcatctggctactcaac

SEQ ID NO: 2883 - DNA, 20 bp, Artificial sequence
  Synthetic oligonucleotide
aatttcatctggctactcaa

SEQ ID NO: 2884 - DNA, 20 bp, Artificial sequence
  Synthetic oligonucleotide
gaatttcatctggctactca

SEQ ID NO: 2885 - DNA, 20 bp, Artificial sequence
  Synthetic oligonucleotide
tgaatttcatctggctactc

SEQ ID NO: 2886 - DNA, 20 bp, Artificial sequence
  Synthetic oligonucleotide
ttgaatttcatctggctact

SEQ ID NO: 2887 - DNA, 20 bp, Artificial sequence
  Synthetic oligonucleotide
cttgaatttcatctggctac

SEQ ID NO: 2888 - DNA, 20 bp, Artificial sequence
  Synthetic oligonucleotide
gcttgaatttcatctggcta

SEQ ID NO: 2889 - DNA, 20 bp, Artificial sequence
  Synthetic oligonucleotide
ggcttgaatttcatctggct

SEQ ID NO: 2890 - DNA, 20 bp, Artificial sequence
  Synthetic oligonucleotide
aggcttgaatttcatctggc

SEQ ID NO: 2891 - DNA, 20 bp, Artificial sequence
  Synthetic oligonucleotide
taggcttgaatttcatctgg

SEQ ID NO: 2892 - DNA, 20 bp, Artificial sequence
  Synthetic oligonucleotide
ttaggcttgaatttcatctg

SEQ ID NO: 2893 - DNA, 20 bp, Artificial sequence
  Synthetic oligonucleotide
tttaggcttgaatttcatct

SEQ ID NO: 2894 - DNA, 20 bp, Artificial sequence
  Synthetic oligonucleotide
ctttaggcttgaatttcatc

SEQ ID NO: 2895 - DNA, 20 bp, Artificial sequence
  Synthetic oligonucleotide
tctttaggcttgaatttcat

SEQ ID NO: 2896 - DNA, 20 bp, Artificial sequence
  Synthetic oligonucleotide
gtctttaggcttgaatttca

SEQ ID NO: 2897 - DNA, 20 bp, Artificial sequence
  Synthetic oligonucleotide
tgtctttaggcttgaatttc

SEQ ID NO: 2898 - DNA, 20 bp, Artificial sequence
  Synthetic oligonucleotide
ttgtctttaggcttgaattt

SEQ ID NO: 2899 - DNA, 20 bp, Artificial sequence
  Synthetic oligonucleotide
attgtctttaggcttgaatt

SEQ ID NO: 2900 - DNA, 20 bp, Artificial sequence
  Synthetic oligonucleotide
aattgtctttaggcttgaat

SEQ ID NO: 2901 - DNA, 20 bp, Artificial sequence
  Synthetic oligonucleotide
gaattgtctttaggcttgaa

SEQ ID NO: 2902 - DNA, 20 bp, Artificial sequence
  Synthetic oligonucleotide
tgaattgtctttaggcttga

SEQ ID NO: 2903 - DNA, 20 bp, Artificial sequence
  Synthetic oligonucleotide
atgaattgtctttaggcttg

SEQ ID NO: 2904 - DNA, 20 bp, Artificial sequence
  Synthetic oligonucleotide
aatgaattgtctttaggctt

SEQ ID NO: 2905 - DNA, 20 bp, Artificial sequence
  Synthetic oligonucleotide
gaatgaattgtctttaggct

SEQ ID NO: 2906 - DNA, 20 bp, Artificial sequence
  Synthetic oligonucleotide
tgaatgaattgtctttaggc

SEQ ID NO: 2907 - DNA, 20 bp, Artificial sequence
  Synthetic oligonucleotide
atgaatgaattgtctttagg

SEQ ID NO: 2908 - DNA, 20 bp, Artificial sequence
  Synthetic oligonucleotide
aatgaatgaattgtctttag

SEQ ID NO: 2909 - DNA, 20 bp, Artificial sequence
  Synthetic oligonucleotide
caaatgaatgaattgtcttt

SEQ ID NO: 2910 - DNA, 20 bp, Artificial sequence
  Synthetic oligonucleotide
gcaaatgaatgaattgtctt

SEQ ID NO: 2911 - DNA, 20 bp, Artificial sequence
  Synthetic oligonucleotide
tgcaaatgaatgaattgtct

SEQ ID NO: 2912 - DNA, 20 bp, Artificial sequence
  Synthetic oligonucleotide
atgcaaatgaatgaattgtc

SEQ ID NO: 2913 - DNA, 20 bp, Artificial sequence
  Synthetic oligonucleotide
gatgcaaatgaatgaattgt

SEQ ID NO: 2914 - DNA, 20 bp, Artificial sequence
  Synthetic oligonucleotide
ggatgcaaatgaatgaattg

SEQ ID NO: 2915 - DNA, 20 bp, Artificial sequence
  Synthetic oligonucleotide
tggatgcaaatgaatgaatt

SEQ ID NO: 2916 - DNA, 20 bp, Artificial sequence
  Synthetic oligonucleotide
atggatgcaaatgaatgaat

SEQ ID NO: 2917 - DNA, 20 bp, Artificial sequence
  Synthetic oligonucleotide
catggatgcaaatgaatgaa

SEQ ID NO: 2918 - DNA, 20 bp, Artificial sequence
  Synthetic oligonucleotide
ccatggatgcaaatgaatga

SEQ ID NO: 2919 - DNA, 20 bp, Artificial sequence
  Synthetic oligonucleotide
cccatggatgcaaatgaatg

SEQ ID NO: 2920 - DNA, 20 bp, Artificial sequence
  Synthetic oligonucleotide
gcccatggatgcaaatgaat

SEQ ID NO: 2921 - DNA, 20 bp, Artificial sequence
  Synthetic oligonucleotide
tgcccatggatgcaaatgaa

SEQ ID NO: 2922 - DNA, 20 bp, Artificial sequence
  Synthetic oligonucleotide
cttctgtgcccatggatgca

SEQ ID NO: 2923 - DNA, 20 bp, Artificial sequence
  Synthetic oligonucleotide
accttctgtgcccatggatg

SEQ ID NO: 2924 - DNA, 20 bp, Artificial sequence
  Synthetic oligonucleotide
aaccttctgtgcccatggat

SEQ ID NO: 2925 - DNA, 20 bp, Artificial sequence
  Synthetic oligonucleotide
caaccttctgtgcccatgga

SEQ ID NO: 2926 - DNA, 20 bp, Artificial sequence
  Synthetic oligonucleotide
agcaaccttctgtgcccatg

SEQ ID NO: 2927 - DNA, 20 bp, Artificial sequence
  Synthetic oligonucleotide
tagcaaccttctgtgcccat

SEQ ID NO: 2928 - DNA, 20 bp, Artificial sequence
  Synthetic oligonucleotide
atagcaaccttctgtgccca

SEQ ID NO: 2929 - DNA, 20 bp, Artificial sequence
  Synthetic oligonucleotide
tatagcaaccttctgtgccc

SEQ ID NO: 2930 - DNA, 20 bp, Artificial sequence
  Synthetic oligonucleotide
atatagcaaccttctgtgcc

SEQ ID NO: 2931 - DNA, 20 bp, Artificial sequence
  Synthetic oligonucleotide
tatatagcaaccttctgtgc

SEQ ID NO: 2932 - DNA, 20 bp, Artificial sequence
  Synthetic oligonucleotide
ctatatagcaaccttctgtg

SEQ ID NO: 2933 - DNA, 20 bp, Artificial sequence
  Synthetic oligonucleotide
actatatagcaaccttctgt

SEQ ID NO: 2934 - DNA, 20 bp, Artificial sequence
  Synthetic oligonucleotide
tactatatagcaaccttctg

SEQ ID NO: 2935 - DNA, 20 bp, Artificial sequence
  Synthetic oligonucleotide
atactatatagcaaccttct

SEQ ID NO: 2936 - DNA, 20 bp, Artificial sequence
  Synthetic oligonucleotide
gatactatatagcaaccttc

SEQ ID NO: 2937 - DNA, 20 bp, Artificial sequence
  Synthetic oligonucleotide
agatactatatagcaacctt

SEQ ID NO: 2938 - DNA, 20 bp, Artificial sequence
  Synthetic oligonucleotide
tagatactatatagcaacct

SEQ ID NO: 2939 - DNA, 20 bp, Artificial sequence
  Synthetic oligonucleotide
gtagatactatatagcaacc

SEQ ID NO: 2940 - DNA, 20 bp, Artificial sequence
  Synthetic oligonucleotide
ggtagatactatatagcaac

SEQ ID NO: 2941 - DNA, 20 bp, Artificial sequence
  Synthetic oligonucleotide
aggtagatactatatagcaa

SEQ ID NO: 2942 - DNA, 20 bp, Artificial sequence
  Synthetic oligonucleotide
aaggtagatactatatagca

SEQ ID NO: 2943 - DNA, 20 bp, Artificial sequence
  Synthetic oligonucleotide
aaaggtagatactatatagc

SEQ ID NO: 2944 - DNA, 20 bp, Artificial sequence
  Synthetic oligonucleotide
aaaaggtagatactatatag

SEQ ID NO: 2945 - DNA, 20 bp, Artificial sequence
  Synthetic oligonucleotide
caaaaggtagatactatata

SEQ ID NO: 2946 - DNA, 20 bp, Artificial sequence
  Synthetic oligonucleotide
gcaaaaggtagatactatat

SEQ ID NO: 2947 - DNA, 20 bp, Artificial sequence
  Synthetic oligonucleotide
agcaaaaggtagatactata

SEQ ID NO: 2948 - DNA, 20 bp, Artificial sequence
  Synthetic oligonucleotide
tagcaaaaggtagatactat

SEQ ID NO: 2949 - DNA, 20 bp, Artificial sequence
  Synthetic oligonucleotide
gtagcaaaaggtagatacta

SEQ ID NO: 2950 - DNA, 20 bp, Artificial sequence
  Synthetic oligonucleotide
agtagcaaaaggtagatact

SEQ ID NO: 2951 - DNA, 20 bp, Artificial sequence
  Synthetic oligonucleotide
aagtagcaaaaggtagatac

SEQ ID NO: 2952 - DNA, 20 bp, Artificial sequence
  Synthetic oligonucleotide
taagtagcaaaaggtagata

SEQ ID NO: 2953 - DNA, 20 bp, Artificial sequence
  Synthetic oligonucleotide
ataagtagcaaaaggtagat

SEQ ID NO: 2954 - DNA, 20 bp, Artificial sequence
  Synthetic oligonucleotide
aataagtagcaaaaggtaga

SEQ ID NO: 2955 - DNA, 20 bp, Artificial sequence
  Synthetic oligonucleotide
aaataagtagcaaaaggtag

SEQ ID NO: 2956 - DNA, 20 bp, Artificial sequence
  Synthetic oligonucleotide
taaataagtagcaaaaggta

SEQ ID NO: 2957 - DNA, 20 bp, Artificial sequence
  Synthetic oligonucleotide
ttaaataagtagcaaaaggt

SEQ ID NO: 2958 - DNA, 20 bp, Artificial sequence
  Synthetic oligonucleotide
attaaataagtagcaaaagg

SEQ ID NO: 2959 - DNA, 20 bp, Artificial sequence
  Synthetic oligonucleotide
cattaaataagtagcaaaag

SEQ ID NO: 2960 - DNA, 20 bp, Artificial sequence
  Synthetic oligonucleotide
caatcaaactgtcattaaat

SEQ ID NO: 2961 - DNA, 20 bp, Artificial sequence
  Synthetic oligonucleotide
ccaatcaaactgtcattaaa

SEQ ID NO: 2962 - DNA, 20 bp, Artificial sequence
  Synthetic oligonucleotide
accaatcaaactgtcattaa

SEQ ID NO: 2963 - DNA, 20 bp, Artificial sequence
  Synthetic oligonucleotide
aaccaatcaaactgtcatta

SEQ ID NO: 2964 - DNA, 20 bp, Artificial sequence
  Synthetic oligonucleotide
caaccaatcaaactgtcatt

SEQ ID NO: 2965 - DNA, 20 bp, Artificial sequence
  Synthetic oligonucleotide
gcaaccaatcaaactgtcat

SEQ ID NO: 2966 - DNA, 20 bp, Artificial sequence
  Synthetic oligonucleotide
agcaaccaatcaaactgtca

SEQ ID NO: 2967 - DNA, 20 bp, Artificial sequence
  Synthetic oligonucleotide
aagcaaccaatcaaactgtc

SEQ ID NO: 2968 - DNA, 20 bp, Artificial sequence
  Synthetic oligonucleotide
caagcaaccaatcaaactgt

SEQ ID NO: 2969 - DNA, 20 bp, Artificial sequence
  Synthetic oligonucleotide
ccaagcaaccaatcaaactg

SEQ ID NO: 2970 - DNA, 20 bp, Artificial sequence
  Synthetic oligonucleotide
accaagcaaccaatcaaact

SEQ ID NO: 2971 - DNA, 20 bp, Artificial sequence
  Synthetic oligonucleotide
aaccaagcaaccaatcaaac

SEQ ID NO: 2972 - DNA, 20 bp, Artificial sequence
  Synthetic oligonucleotide
aaaccaagcaaccaatcaaa

SEQ ID NO: 2973 - DNA, 20 bp, Artificial sequence
  Synthetic oligonucleotide
caaaccaagcaaccaatcaa

SEQ ID NO: 2974 - DNA, 20 bp, Artificial sequence
  Synthetic oligonucleotide
acaaaccaagcaaccaatca

SEQ ID NO: 2975 - DNA, 20 bp, Artificial sequence
  Synthetic oligonucleotide
aacaaaccaagcaaccaatc

SEQ ID NO: 2976 - DNA, 20 bp, Artificial sequence
  Synthetic oligonucleotide
taacaaaccaagcaaccaat

SEQ ID NO: 2977 - DNA, 20 bp, Artificial sequence
  Synthetic oligonucleotide
ataacaaaccaagcaaccaa

SEQ ID NO: 2978 - DNA, 20 bp, Artificial sequence
  Synthetic oligonucleotide
aataacaaaccaagcaacca

SEQ ID NO: 2979 - DNA, 20 bp, Artificial sequence
  Synthetic oligonucleotide
aaataacaaaccaagcaacc

SEQ ID NO: 2980 - DNA, 20 bp, Artificial sequence
  Synthetic oligonucleotide
caaataacaaaccaagcaac

SEQ ID NO: 2981 - DNA, 20 bp, Artificial sequence
  Synthetic oligonucleotide
tcaaataacaaaccaagcaa

SEQ ID NO: 2982 - DNA, 20 bp, Artificial sequence
  Synthetic oligonucleotide
ttcaaataacaaaccaagca

SEQ ID NO: 2983 - DNA, 20 bp, Artificial sequence
  Synthetic oligonucleotide
cttcaaataacaaaccaagc

SEQ ID NO: 2984 - DNA, 20 bp, Artificial sequence
  Synthetic oligonucleotide
ccttcaaataacaaaccaag

SEQ ID NO: 2985 - DNA, 20 bp, Artificial sequence
  Synthetic oligonucleotide
cccttcaaataacaaaccaa

SEQ ID NO: 2986 - DNA, 20 bp, Artificial sequence
  Synthetic oligonucleotide
acccttcaaataacaaacca

SEQ ID NO: 2987 - DNA, 20 bp, Artificial sequence
  Synthetic oligonucleotide
cacccttcaaataacaaacc

SEQ ID NO: 2988 - DNA, 20 bp, Artificial sequence
  Synthetic oligonucleotide
acacccttcaaataacaaac

SEQ ID NO: 2989 - DNA, 20 bp, Artificial sequence
  Synthetic oligonucleotide
cacacccttcaaataacaaa

SEQ ID NO: 2990 - DNA, 20 bp, Artificial sequence
  Synthetic oligonucleotide
tcacacccttcaaataacaa

SEQ ID NO: 2991 - DNA, 20 bp, Artificial sequence
  Synthetic oligonucleotide
atcacacccttcaaataaca

SEQ ID NO: 2992 - DNA, 20 bp, Artificial sequence
  Synthetic oligonucleotide
aatcacacccttcaaataac

SEQ ID NO: 2993 - DNA, 20 bp, Artificial sequence
  Synthetic oligonucleotide
aaatcacacccttcaaataa

SEQ ID NO: 2994 - DNA, 20 bp, Artificial sequence
  Synthetic oligonucleotide
aaaatcacacccttcaaata

SEQ ID NO: 2995 - DNA, 20 bp, Artificial sequence
  Synthetic oligonucleotide
aaaaatcacacccttcaaat

SEQ ID NO: 2996 - DNA, 20 bp, Artificial sequence
  Synthetic oligonucleotide
caaaaatcacacccttcaaa

SEQ ID NO: 2997 - DNA, 20 bp, Artificial sequence
  Synthetic oligonucleotide
acaaaaatcacacccttcaa

SEQ ID NO: 2998 - DNA, 20 bp, Artificial sequence
  Synthetic oligonucleotide
aacaaaaatcacacccttca

SEQ ID NO: 2999 - DNA, 20 bp, Artificial sequence
  Synthetic oligonucleotide
aaacaaaaatcacacccttc

SEQ ID NO: 3000 - DNA, 20 bp, Artificial sequence
  Synthetic oligonucleotide
aaaacaaaaatcacaccctt

SEQ ID NO: 3001 - DNA, 20 bp, Artificial sequence
  Synthetic oligonucleotide
aaaaacaaaaatcacaccct

SEQ ID NO: 3002 - DNA, 20 bp, Artificial sequence
  Synthetic oligonucleotide
caaaaacaaaaatcacaccc

SEQ ID NO: 3003 - DNA, 20 bp, Artificial sequence
  Synthetic oligonucleotide
acaaaaacaaaaatcacacc

SEQ ID NO: 3004 - DNA, 20 bp, Artificial sequence
  Synthetic oligonucleotide
tacaaaaacaaaaatcacac

SEQ ID NO: 3005 - DNA, 20 bp, Artificial sequence
  Synthetic oligonucleotide
gtacaaaaacaaaaatcaca

SEQ ID NO: 3006 - DNA, 20 bp, Artificial sequence
  Synthetic oligonucleotide
tgtacaaaaacaaaaatcac

SEQ ID NO: 3007 - DNA, 20 bp, Artificial sequence
  Synthetic oligonucleotide
ctgtacaaaaacaaaaatca

SEQ ID NO: 3008 - DNA, 20 bp, Artificial sequence
  Synthetic oligonucleotide
actgtacaaaaacaaaaatc

SEQ ID NO: 3009 - DNA, 20 bp, Artificial sequence
  Synthetic oligonucleotide
caaatgtgaagcttgaaaaa

SEQ ID NO: 3010 - DNA, 20 bp, Artificial sequence
  Synthetic oligonucleotide
gcaaatgtgaagcttgaaaa

SEQ ID NO: 3011 - DNA, 20 bp, Artificial sequence
  Synthetic oligonucleotide
cgcaaatgtgaagcttgaaa

SEQ ID NO: 3012 - DNA, 20 bp, Artificial sequence
  Synthetic oligonucleotide
acgcaaatgtgaagcttgaa

SEQ ID NO: 3013 - DNA, 20 bp, Artificial sequence
  Synthetic oligonucleotide
aattagatacacgcaaatgt

SEQ ID NO: 3014 - DNA, 20 bp, Artificial sequence
  Synthetic oligonucleotide
gaattagatacacgcaaatg

SEQ ID NO: 3015 - DNA, 20 bp, Artificial sequence
  Synthetic oligonucleotide
tgaattagatacacgcaaat

SEQ ID NO: 3016 - DNA, 20 bp, Artificial sequence
  Synthetic oligonucleotide
ctgaattagatacacgcaaa

SEQ ID NO: 3017 - DNA, 20 bp, Artificial sequence
  Synthetic oligonucleotide
gctgaattagatacacgcaa

SEQ ID NO: 3018 - DNA, 20 bp, Artificial sequence
  Synthetic oligonucleotide
agctgaattagatacacgca

SEQ ID NO: 3019 - DNA, 20 bp, Artificial sequence
  Synthetic oligonucleotide
cagctgaattagatacacgc

SEQ ID NO: 3020 - DNA, 20 bp, Artificial sequence
  Synthetic oligonucleotide
tcagctgaattagatacacg

SEQ ID NO: 3021 - DNA, 20 bp, Artificial sequence
  Synthetic oligonucleotide
atcagctgaattagatacac

SEQ ID NO: 3022 - DNA, 20 bp, Artificial sequence
  Synthetic oligonucleotide
catcagctgaattagataca

SEQ ID NO: 3023 - DNA, 20 bp, Artificial sequence
  Synthetic oligonucleotide
accccttggacttgagcatc

SEQ ID NO: 3024 - DNA, 20 bp, Artificial sequence
  Synthetic oligonucleotide
taccccttggacttgagcat

SEQ ID NO: 3025 - DNA, 20 bp, Artificial sequence
  Synthetic oligonucleotide
ctaccccttggacttgagca

SEQ ID NO: 3026 - DNA, 20 bp, Artificial sequence
  Synthetic oligonucleotide
actaccccttggacttgagc

SEQ ID NO: 3027 - DNA, 20 bp, Artificial sequence
  Synthetic oligonucleotide
gactaccccttggacttgag

SEQ ID NO: 3028 - DNA, 20 bp, Artificial sequence
  Synthetic oligonucleotide
agactaccccttggacttga

SEQ ID NO: 3029 - DNA, 20 bp, Artificial sequence
  Synthetic oligonucleotide
cagactaccccttggacttg

SEQ ID NO: 3030 - DNA, 20 bp, Artificial sequence
  Synthetic oligonucleotide
gcagactaccccttggactt

SEQ ID NO: 3031 - DNA, 20 bp, Artificial sequence
  Synthetic oligonucleotide
aaggcagactaccccttgga

SEQ ID NO: 3032 - DNA, 20 bp, Artificial sequence
  Synthetic oligonucleotide
agactgaagggaaaagaggg

SEQ ID NO: 3033 - DNA, 20 bp, Artificial sequence
  Synthetic oligonucleotide
aagactgaagggaaaagagg

SEQ ID NO: 3034 - DNA, 20 bp, Artificial sequence
  Synthetic oligonucleotide
gaagactgaagggaaaagag

SEQ ID NO: 3035 - DNA, 20 bp, Artificial sequence
  Synthetic oligonucleotide
agaagactgaagggaaaaga

SEQ ID NO: 3036 - DNA, 20 bp, Artificial sequence
  Synthetic oligonucleotide
aagaagactgaagggaaaag

SEQ ID NO: 3037 - DNA, 20 bp, Artificial sequence
  Synthetic oligonucleotide
gaagaagactgaagggaaaa

SEQ ID NO: 3038 - DNA, 20 bp, Artificial sequence
  Synthetic oligonucleotide
tgaagaagactgaagggaaa

SEQ ID NO: 3039 - DNA, 20 bp, Artificial sequence
  Synthetic oligonucleotide
gtgaagaagactgaagggaa

SEQ ID NO: 3040 - DNA, 20 bp, Artificial sequence
  Synthetic oligonucleotide
agtgaagaagactgaaggga

SEQ ID NO: 3041 - DNA, 20 bp, Artificial sequence
  Synthetic oligonucleotide
aagtgaagaagactgaaggg

SEQ ID NO: 3042 - DNA, 20 bp, Artificial sequence
  Synthetic oligonucleotide
gaagtgaagaagactgaagg

SEQ ID NO: 3043 - DNA, 20 bp, Artificial sequence
  Synthetic oligonucleotide
ggaagtgaagaagactgaag

SEQ ID NO: 3044 - DNA, 20 bp, Artificial sequence
  Synthetic oligonucleotide
gggaagtgaagaagactgaa

SEQ ID NO: 3045 - DNA, 20 bp, Artificial sequence
  Synthetic oligonucleotide
agggaagtgaagaagactga

SEQ ID NO: 3046 - DNA, 20 bp, Artificial sequence
  Synthetic oligonucleotide
tagggaagtgaagaagactg

SEQ ID NO: 3047 - DNA, 20 bp, Artificial sequence
  Synthetic oligonucleotide
atagggaagtgaagaagact

SEQ ID NO: 3048 - DNA, 20 bp, Artificial sequence
  Synthetic oligonucleotide
catagggaagtgaagaagac

SEQ ID NO: 3049 - DNA, 20 bp, Artificial sequence
  Synthetic oligonucleotide
gcatagggaagtgaagaaga

SEQ ID NO: 3050 - DNA, 20 bp, Artificial sequence
  Synthetic oligonucleotide
agcatagggaagtgaagaag

SEQ ID NO: 3051 - DNA, 20 bp, Artificial sequence
  Synthetic oligonucleotide
cagcatagggaagtgaagaa

SEQ ID NO: 3052 - DNA, 20 bp, Artificial sequence
  Synthetic oligonucleotide
gcagcatagggaagtgaaga

SEQ ID NO: 3053 - DNA, 20 bp, Artificial sequence
  Synthetic oligonucleotide
agcagcatagggaagtgaag

SEQ ID NO: 3054 - DNA, 20 bp, Artificial sequence
  Synthetic oligonucleotide
cagcagcatagggaagtgaa

SEQ ID NO: 3055 - DNA, 20 bp, Artificial sequence
  Synthetic oligonucleotide
tgtagcacatgaagcagcag

SEQ ID NO: 3056 - DNA, 20 bp, Artificial sequence
  Synthetic oligonucleotide
atgtagcacatgaagcagca

SEQ ID NO: 3057 - DNA, 20 bp, Artificial sequence
  Synthetic oligonucleotide
gatgtagcacatgaagcagc

SEQ ID NO: 3058 - DNA, 20 bp, Artificial sequence
  Synthetic oligonucleotide
agatgtagcacatgaagcag

SEQ ID NO: 3059 - DNA, 20 bp, Artificial sequence
  Synthetic oligonucleotide
gagatgtagcacatgaagca

SEQ ID NO: 3060 - DNA, 20 bp, Artificial sequence
  Synthetic oligonucleotide
tgagatgtagcacatgaagc

SEQ ID NO: 3061 - DNA, 20 bp, Artificial sequence
  Synthetic oligonucleotide
ctgagatgtagcacatgaag

SEQ ID NO: 3062 - DNA, 20 bp, Artificial sequence
  Synthetic oligonucleotide
tctgagatgtagcacatgaa

SEQ ID NO: 3063 - DNA, 20 bp, Artificial sequence
  Synthetic oligonucleotide
gtctgagatgtagcacatga

SEQ ID NO: 3064 - DNA, 20 bp, Artificial sequence
  Synthetic oligonucleotide
agtctgagatgtagcacatg

SEQ ID NO: 3065 - DNA, 20 bp, Artificial sequence
  Synthetic oligonucleotide
taagtctgagatgtagcaca

SEQ ID NO: 3066 - DNA, 20 bp, Artificial sequence
  Synthetic oligonucleotide
ttaagtctgagatgtagcac

SEQ ID NO: 3067 - DNA, 20 bp, Artificial sequence
  Synthetic oligonucleotide
tttaagtctgagatgtagca

SEQ ID NO: 3068 - DNA, 20 bp, Artificial sequence
  Synthetic oligonucleotide
ctttaagtctgagatgtagc

SEQ ID NO: 3069 - DNA, 20 bp, Artificial sequence
  Synthetic oligonucleotide
tctttaagtctgagatgtag

SEQ ID NO: 3070 - DNA, 20 bp, Artificial sequence
  Synthetic oligonucleotide
ctctttaagtctgagatgta

SEQ ID NO: 3071 - DNA, 20 bp, Artificial sequence
  Synthetic oligonucleotide
actctttaagtctgagatgt

SEQ ID NO: 3072 - DNA, 20 bp, Artificial sequence
  Synthetic oligonucleotide
aactctttaagtctgagatg

SEQ ID NO: 3073 - DNA, 20 bp, Artificial sequence
  Synthetic oligonucleotide
aaactctttaagtctgagat

SEQ ID NO: 3074 - DNA, 20 bp, Artificial sequence
  Synthetic oligonucleotide
gaaactctttaagtctgaga

SEQ ID NO: 3075 - DNA, 20 bp, Artificial sequence
  Synthetic oligonucleotide
agaaactctttaagtctgag

SEQ ID NO: 3076 - DNA, 20 bp, Artificial sequence
  Synthetic oligonucleotide
gagaaactctttaagtctga

SEQ ID NO: 3077 - DNA, 20 bp, Artificial sequence
  Synthetic oligonucleotide
agagaaactctttaagtctg

SEQ ID NO: 3078 - DNA, 20 bp, Artificial sequence
  Synthetic oligonucleotide
tcactgtagtagagaaactc

SEQ ID NO: 3079 - DNA, 20 bp, Artificial sequence
  Synthetic oligonucleotide
ttcactgtagtagagaaact

SEQ ID NO: 3080 - DNA, 20 bp, Artificial sequence
  Synthetic oligonucleotide
tttcactgtagtagagaaac

SEQ ID NO: 3081 - DNA, 20 bp, Artificial sequence
  Synthetic oligonucleotide
gttttcactgtagtagagaa

SEQ ID NO: 3082 - DNA, 20 bp, Artificial sequence
  Synthetic oligonucleotide
tgttttcactgtagtagaga

SEQ ID NO: 3083 - DNA, 20 bp, Artificial sequence
  Synthetic oligonucleotide
atgttttcactgtagtagag

SEQ ID NO: 3084 - DNA, 20 bp, Artificial sequence
  Synthetic oligonucleotide
aatgttttcactgtagtaga

SEQ ID NO: 3085 - DNA, 20 bp, Artificial sequence
  Synthetic oligonucleotide
gaatgttttcactgtagtag

SEQ ID NO: 3086 - DNA, 20 bp, Artificial sequence
  Synthetic oligonucleotide
agaatgttttcactgtagta

SEQ ID NO: 3087 - DNA, 20 bp, Artificial sequence
  Synthetic oligonucleotide
gagaatgttttcactgtagt

SEQ ID NO: 3088 - DNA, 20 bp, Artificial sequence
  Synthetic oligonucleotide
agagaatgttttcactgtag

SEQ ID NO: 3089 - DNA, 20 bp, Artificial sequence
  Synthetic oligonucleotide
tagagaatgttttcactgta

SEQ ID NO: 3090 - DNA, 20 bp, Artificial sequence
  Synthetic oligonucleotide
ctagagaatgttttcactgt

SEQ ID NO: 3091 - DNA, 20 bp, Artificial sequence
  Synthetic oligonucleotide
cctagagaatgttttcactg

SEQ ID NO: 3092 - DNA, 20 bp, Artificial sequence
  Synthetic oligonucleotide
ccctagagaatgttttcact

SEQ ID NO: 3093 - DNA, 20 bp, Artificial sequence
  Synthetic oligonucleotide
accctagagaatgttttcac

SEQ ID NO: 3094 - DNA, 20 bp, Artificial sequence
  Synthetic oligonucleotide
gaccctagagaatgttttca

SEQ ID NO: 3095 - DNA, 20 bp, Artificial sequence
  Synthetic oligonucleotide
agaccctagagaatgttttc

SEQ ID NO: 3096 - DNA, 20 bp, Artificial sequence
  Synthetic oligonucleotide
aagaccctagagaatgtttt

SEQ ID NO: 3097 - DNA, 20 bp, Artificial sequence
  Synthetic oligonucleotide
aaagaccctagagaatgttt

SEQ ID NO: 3098 - DNA, 20 bp, Artificial sequence
  Synthetic oligonucleotide
gaaagaccctagagaatgtt

SEQ ID NO: 3099 - DNA, 20 bp, Artificial sequence
  Synthetic oligonucleotide
tgaaagaccctagagaatgt

SEQ ID NO: 3100 - DNA, 20 bp, Artificial sequence
  Synthetic oligonucleotide
atgaaagaccctagagaatg

SEQ ID NO: 3101 - DNA, 20 bp, Artificial sequence
  Synthetic oligonucleotide
gatgaaagaccctagagaat

SEQ ID NO: 3102 - DNA, 20 bp, Artificial sequence
  Synthetic oligonucleotide
tgatgaaagaccctagagaa

SEQ ID NO: 3103 - DNA, 20 bp, Artificial sequence
  Synthetic oligonucleotide
ctgatgaaagaccctagaga

SEQ ID NO: 3104 - DNA, 20 bp, Artificial sequence
  Synthetic oligonucleotide
cctgatgaaagaccctagag

SEQ ID NO: 3105 - DNA, 20 bp, Artificial sequence
  Synthetic oligonucleotide
gcctgatgaaagaccctaga

SEQ ID NO: 3106 - DNA, 20 bp, Artificial sequence
  Synthetic oligonucleotide
ggcctgatgaaagaccctag

SEQ ID NO: 3107 - DNA, 20 bp, Artificial sequence
  Synthetic oligonucleotide
aggcctgatgaaagacccta

SEQ ID NO: 3108 - DNA, 20 bp, Artificial sequence
  Synthetic oligonucleotide
aaggcctgatgaaagaccct

SEQ ID NO: 3109 - DNA, 20 bp, Artificial sequence
  Synthetic oligonucleotide
aaaggcctgatgaaagaccc

SEQ ID NO: 3110 - DNA, 20 bp, Artificial sequence
  Synthetic oligonucleotide
taaaggcctgatgaaagacc

SEQ ID NO: 3111 - DNA, 20 bp, Artificial sequence
  Synthetic oligonucleotide
ctaaaggcctgatgaaagac

SEQ ID NO: 3112 - DNA, 20 bp, Artificial sequence
  Synthetic oligonucleotide
actaaaggcctgatgaaaga

SEQ ID NO: 3113 - DNA, 20 bp, Artificial sequence
  Synthetic oligonucleotide
aactaaaggcctgatgaaag

SEQ ID NO: 3114 - DNA, 20 bp, Artificial sequence
  Synthetic oligonucleotide
taactaaaggcctgatgaaa

SEQ ID NO: 3115 - DNA, 20 bp, Artificial sequence
  Synthetic oligonucleotide
ataactaaaggcctgatgaa

SEQ ID NO: 3116 - DNA, 20 bp, Artificial sequence
  Synthetic oligonucleotide
aataactaaaggcctgatga

SEQ ID NO: 3117 - DNA, 20 bp, Artificial sequence
  Synthetic oligonucleotide
aaataactaaaggcctgatg

SEQ ID NO: 3118 - DNA, 20 bp, Artificial sequence
  Synthetic oligonucleotide
aaaataactaaaggcctgat

SEQ ID NO: 3119 - DNA, 20 bp, Artificial sequence
  Synthetic oligonucleotide
taaaataactaaaggcctga

SEQ ID NO: 3120 - DNA, 20 bp, Artificial sequence
  Synthetic oligonucleotide
ctaaaataactaaaggcctg

SEQ ID NO: 3121 - DNA, 20 bp, Artificial sequence
  Synthetic oligonucleotide
cctaaaataactaaaggcct

SEQ ID NO: 3122 - DNA, 20 bp, Artificial sequence
  Synthetic oligonucleotide
ccctaaaataactaaaggcc

SEQ ID NO: 3123 - DNA, 20 bp, Artificial sequence
  Synthetic oligonucleotide
tccctaaaataactaaaggc

SEQ ID NO: 3124 - DNA, 20 bp, Artificial sequence
  Synthetic oligonucleotide
atccctaaaataactaaagg

SEQ ID NO: 3125 - DNA, 20 bp, Artificial sequence
  Synthetic oligonucleotide
tatccctaaaataactaaag

SEQ ID NO: 3126 - DNA, 20 bp, Artificial sequence
  Synthetic oligonucleotide
gtttttatccctaaaataac

SEQ ID NO: 3127 - DNA, 20 bp, Artificial sequence
  Synthetic oligonucleotide
caatagtttttatccctaaa

SEQ ID NO: 3128 - DNA, 20 bp, Artificial sequence
  Synthetic oligonucleotide
tcaatagtttttatccctaa

SEQ ID NO: 3129 - DNA, 20 bp, Artificial sequence
  Synthetic oligonucleotide
atcaatagtttttatcccta

SEQ ID NO: 3130 - DNA, 20 bp, Artificial sequence
  Synthetic oligonucleotide
tatcaatagtttttatccct

SEQ ID NO: 3131 - DNA, 20 bp, Artificial sequence
  Synthetic oligonucleotide
ttatcaatagtttttatccc

SEQ ID NO: 3132 - DNA, 20 bp, Artificial sequence
  Synthetic oligonucleotide
gtcctttttatcaatagttt

SEQ ID NO: 3133 - DNA, 20 bp, Artificial sequence
  Synthetic oligonucleotide
tgtcctttttatcaatagtt

SEQ ID NO: 3134 - DNA, 20 bp, Artificial sequence
  Synthetic oligonucleotide
ttgtcctttttatcaatagt

SEQ ID NO: 3135 - DNA, 20 bp, Artificial sequence
  Synthetic oligonucleotide
cttgtcctttttatcaatag

SEQ ID NO: 3136 - DNA, 20 bp, Artificial sequence
  Synthetic oligonucleotide
ccttgtcctttttatcaata

SEQ ID NO: 3137 - DNA, 20 bp, Artificial sequence
  Synthetic oligonucleotide
tccttgtcctttttatcaat

SEQ ID NO: 3138 - DNA, 20 bp, Artificial sequence
  Synthetic oligonucleotide
atccttgtcctttttatcaa

SEQ ID NO: 3139 - DNA, 20 bp, Artificial sequence
  Synthetic oligonucleotide
tatccttgtcctttttatca

SEQ ID NO: 3140 - DNA, 20 bp, Artificial sequence
  Synthetic oligonucleotide
ctatccttgtcctttttatc

SEQ ID NO: 3141 - DNA, 20 bp, Artificial sequence
  Synthetic oligonucleotide
tctatccttgtcctttttat

SEQ ID NO: 3142 - DNA, 20 bp, Artificial sequence
  Synthetic oligonucleotide
ttctatccttgtccttttta

SEQ ID NO: 3143 - DNA, 20 bp, Artificial sequence
  Synthetic oligonucleotide
gttctatccttgtccttttt

SEQ ID NO: 3144 - DNA, 20 bp, Artificial sequence
  Synthetic oligonucleotide
tgttctatccttgtcctttt

SEQ ID NO: 3145 - DNA, 20 bp, Artificial sequence
  Synthetic oligonucleotide
ctgttctatccttgtccttt

SEQ ID NO: 3146 - DNA, 20 bp, Artificial sequence
  Synthetic oligonucleotide
tctgttctatccttgtcctt

SEQ ID NO: 3147 - DNA, 20 bp, Artificial sequence
  Synthetic oligonucleotide
ctctgttctatccttgtcct

SEQ ID NO: 3148 - DNA, 20 bp, Artificial sequence
  Synthetic oligonucleotide
tctctgttctatccttgtcc

SEQ ID NO: 3149 - DNA, 20 bp, Artificial sequence
  Synthetic oligonucleotide
ttctctgttctatccttgtc

SEQ ID NO: 3150 - DNA, 20 bp, Artificial sequence
  Synthetic oligonucleotide
tttctctgttctatccttgt

SEQ ID NO: 3151 - DNA, 20 bp, Artificial sequence
  Synthetic oligonucleotide
ttttctctgttctatccttg

SEQ ID NO: 3152 - DNA, 20 bp, Artificial sequence
  Synthetic oligonucleotide
attttctctgttctatcctt

SEQ ID NO: 3153 - DNA, 20 bp, Artificial sequence
  Synthetic oligonucleotide
aattttctctgttctatcct

SEQ ID NO: 3154 - DNA, 20 bp, Artificial sequence
  Synthetic oligonucleotide
aaattttctctgttctatcc

SEQ ID NO: 3155 - DNA, 20 bp, Artificial sequence
  Synthetic oligonucleotide
taaattttctctgttctatc

SEQ ID NO: 3156 - DNA, 20 bp, Artificial sequence
  Synthetic oligonucleotide
ctttaaattttctctgttct

SEQ ID NO: 3157 - DNA, 20 bp, Artificial sequence
  Synthetic oligonucleotide
actttaaattttctctgttc

SEQ ID NO: 3158 - DNA, 20 bp, Artificial sequence
  Synthetic oligonucleotide
gactttaaattttctctgtt

SEQ ID NO: 3159 - DNA, 20 bp, Artificial sequence
  Synthetic oligonucleotide
ggactttaaattttctctgt

SEQ ID NO: 3160 - DNA, 20 bp, Artificial sequence
  Synthetic oligonucleotide
aggactttaaattttctctg

SEQ ID NO: 3161 - DNA, 20 bp, Artificial sequence
  Synthetic oligonucleotide
caggactttaaattttctct

SEQ ID NO: 3162 - DNA, 20 bp, Artificial sequence
  Synthetic oligonucleotide
acaggactttaaattttctc

SEQ ID NO: 3163 - DNA, 20 bp, Artificial sequence
  Synthetic oligonucleotide
aacaggactttaaattttct

SEQ ID NO: 3164 - DNA, 20 bp, Artificial sequence
  Synthetic oligonucleotide
gaacaggactttaaattttc

SEQ ID NO: 3165 - DNA, 20 bp, Artificial sequence
  Synthetic oligonucleotide
ggaacaggactttaaatttt

SEQ ID NO: 3166 - DNA, 20 bp, Artificial sequence
  Synthetic oligonucleotide
cggaacaggactttaaattt

SEQ ID NO: 3167 - DNA, 20 bp, Artificial sequence
  Synthetic oligonucleotide
ccggaacaggactttaaatt

SEQ ID NO: 3168 - DNA, 20 bp, Artificial sequence
  Synthetic oligonucleotide
cccggaacaggactttaaat

SEQ ID NO: 3169 - DNA, 20 bp, Artificial sequence
  Synthetic oligonucleotide
acccggaacaggactttaaa

SEQ ID NO: 3170 - DNA, 20 bp, Artificial sequence
  Synthetic oligonucleotide
aacccggaacaggactttaa

SEQ ID NO: 3171 - DNA, 20 bp, Artificial sequence
  Synthetic oligonucleotide
aaacccggaacaggacttta

SEQ ID NO: 3172 - DNA, 20 bp, Artificial sequence
  Synthetic oligonucleotide
aaaacccggaacaggacttt

SEQ ID NO: 3173 - DNA, 20 bp, Artificial sequence
  Synthetic oligonucleotide
aaaaacccggaacaggactt

SEQ ID NO: 3174 - DNA, 20 bp, Artificial sequence
  Synthetic oligonucleotide
ctctgagtttttaaagaaaa

SEQ ID NO: 3175 - DNA, 20 bp, Artificial sequence
  Synthetic oligonucleotide
tctctgagtttttaaagaaa

SEQ ID NO: 3176 - DNA, 20 bp, Artificial sequence
  Synthetic oligonucleotide
gtctctgagtttttaaagaa

SEQ ID NO: 3177 - DNA, 20 bp, Artificial sequence
  Synthetic oligonucleotide
agtctctgagtttttaaaga

SEQ ID NO: 3178 - DNA, 20 bp, Artificial sequence
  Synthetic oligonucleotide
cagtctctgagtttttaaag

SEQ ID NO: 3179 - DNA, 20 bp, Artificial sequence
  Synthetic oligonucleotide
tcagtctctgagtttttaaa

SEQ ID NO: 3180 - DNA, 20 bp, Artificial sequence
  Synthetic oligonucleotide
atattgaacatcagtctctg

SEQ ID NO: 3181 - DNA, 20 bp, Artificial sequence
  Synthetic oligonucleotide
gatattgaacatcagtctct

SEQ ID NO: 3182 - DNA, 20 bp, Artificial sequence
  Synthetic oligonucleotide
ggatattgaacatcagtctc

SEQ ID NO: 3183 - DNA, 20 bp, Artificial sequence
  Synthetic oligonucleotide
gggatattgaacatcagtct

SEQ ID NO: 3184 - DNA, 20 bp, Artificial sequence
  Synthetic oligonucleotide
tgggatattgaacatcagtc

SEQ ID NO: 3185 - DNA, 20 bp, Artificial sequence
  Synthetic oligonucleotide
ttgggatattgaacatcagt

SEQ ID NO: 3186 - DNA, 20 bp, Artificial sequence
  Synthetic oligonucleotide
tttgggatattgaacatcag

SEQ ID NO: 3187 - DNA, 20 bp, Artificial sequence
  Synthetic oligonucleotide
gtttgggatattgaacatca

SEQ ID NO: 3188 - DNA, 20 bp, Artificial sequence
  Synthetic oligonucleotide
ggtttgggatattgaacatc

SEQ ID NO: 3189 - DNA, 20 bp, Artificial sequence
  Synthetic oligonucleotide
tggtttgggatattgaacat

SEQ ID NO: 3190 - DNA, 20 bp, Artificial sequence
  Synthetic oligonucleotide
ctggtttgggatattgaaca

SEQ ID NO: 3191 - DNA, 20 bp, Artificial sequence
  Synthetic oligonucleotide
actggtttgggatattgaac

SEQ ID NO: 3192 - DNA, 20 bp, Artificial sequence
  Synthetic oligonucleotide
tactggtttgggatattgaa

SEQ ID NO: 3193 - DNA, 20 bp, Artificial sequence
  Synthetic oligonucleotide
ttactggtttgggatattga

SEQ ID NO: 3194 - DNA, 20 bp, Artificial sequence
  Synthetic oligonucleotide
tttactggtttgggatattg

SEQ ID NO: 3195 - DNA, 20 bp, Artificial sequence
  Synthetic oligonucleotide
ttttactggtttgggatatt

SEQ ID NO: 3196 - DNA, 20 bp, Artificial sequence
  Synthetic oligonucleotide
attttactggtttgggatat

SEQ ID NO: 3197 - DNA, 20 bp, Artificial sequence
  Synthetic oligonucleotide
cattttactggtttgggata

SEQ ID NO: 3198 - DNA, 20 bp, Artificial sequence
  Synthetic oligonucleotide
ccattttactggtttgggat

SEQ ID NO: 3199 - DNA, 20 bp, Artificial sequence
  Synthetic oligonucleotide
gtattttcaccattttactg

SEQ ID NO: 3200 - DNA, 20 bp, Artificial sequence
  Synthetic oligonucleotide
agtattttcaccattttact

SEQ ID NO: 3201 - DNA, 20 bp, Artificial sequence
  Synthetic oligonucleotide
tagtattttcaccattttac

SEQ ID NO: 3202 - DNA, 20 bp, Artificial sequence
  Synthetic oligonucleotide
catagtattttcaccatttt

SEQ ID NO: 3203 - DNA, 20 bp, Artificial sequence
  Synthetic oligonucleotide
tcatagtattttcaccattt

SEQ ID NO: 3204 - DNA, 20 bp, Artificial sequence
  Synthetic oligonucleotide
ctcatagtattttcaccatt

SEQ ID NO: 3205 - DNA, 20 bp, Artificial sequence
  Synthetic oligonucleotide
gctcatagtattttcaccat

SEQ ID NO: 3206 - DNA, 20 bp, Artificial sequence
  Synthetic oligonucleotide
agctcatagtattttcacca

SEQ ID NO: 3207 - DNA, 20 bp, Artificial sequence
  Synthetic oligonucleotide
aagctcatagtattttcacc

SEQ ID NO: 3208 - DNA, 20 bp, Artificial sequence
  Synthetic oligonucleotide
caagctcatagtattttcac

SEQ ID NO: 3209 - DNA, 20 bp, Artificial sequence
  Synthetic oligonucleotide
acaagctcatagtattttca

SEQ ID NO: 3210 - DNA, 20 bp, Artificial sequence
  Synthetic oligonucleotide
aacaagctcatagtattttc

SEQ ID NO: 3211 - DNA, 20 bp, Artificial sequence
  Synthetic oligonucleotide
aaacaagctcatagtatttt

SEQ ID NO: 3212 - DNA, 20 bp, Artificial sequence
  Synthetic oligonucleotide
aaaacaagctcatagtattt

SEQ ID NO: 3213 - DNA, 20 bp, Artificial sequence
  Synthetic oligonucleotide
aaaaacaagctcatagtatt

SEQ ID NO: 3214 - DNA, 20 bp, Artificial sequence
  Synthetic oligonucleotide
ctttcacataaagagatact

SEQ ID NO: 3215 - DNA, 20 bp, Artificial sequence
  Synthetic oligonucleotide
gctttcacataaagagatac

SEQ ID NO: 3216 - DNA, 20 bp, Artificial sequence
  Synthetic oligonucleotide
tgctttcacataaagagata

SEQ ID NO: 3217 - DNA, 20 bp, Artificial sequence
  Synthetic oligonucleotide
ttgctttcacataaagagat

SEQ ID NO: 3218 - DNA, 20 bp, Artificial sequence
  Synthetic oligonucleotide
attgctttcacataaagaga

SEQ ID NO: 3219 - DNA, 20 bp, Artificial sequence
  Synthetic oligonucleotide
aattgctttcacataaagag

SEQ ID NO: 3220 - DNA, 20 bp, Artificial sequence
  Synthetic oligonucleotide
caattgctttcacataaaga

SEQ ID NO: 3221 - DNA, 20 bp, Artificial sequence
  Synthetic oligonucleotide
acaattgctttcacataaag

SEQ ID NO: 3222 - DNA, 20 bp, Artificial sequence
  Synthetic oligonucleotide
gacaattgctttcacataaa

SEQ ID NO: 3223 - DNA, 20 bp, Artificial sequence
  Synthetic oligonucleotide
tgacaattgctttcacataa

SEQ ID NO: 3224 - DNA, 20 bp, Artificial sequence
  Synthetic oligonucleotide
atgacaattgctttcacata

SEQ ID NO: 3225 - DNA, 20 bp, Artificial sequence
  Synthetic oligonucleotide
tatgacaattgctttcacat

SEQ ID NO: 3226 - DNA, 20 bp, Artificial sequence
  Synthetic oligonucleotide
atatgacaattgctttcaca

SEQ ID NO: 3227 - DNA, 20 bp, Artificial sequence
  Synthetic oligonucleotide
gatatgacaattgctttcac

SEQ ID NO: 3228 - DNA, 20 bp, Artificial sequence
  Synthetic oligonucleotide
tgatatgacaattgctttca

SEQ ID NO: 3229 - DNA, 20 bp, Artificial sequence
  Synthetic oligonucleotide
ttgatatgacaattgctttc

SEQ ID NO: 3230 - DNA, 20 bp, Artificial sequence
  Synthetic oligonucleotide
tttgatatgacaattgcttt

SEQ ID NO: 3231 - DNA, 20 bp, Artificial sequence
  Synthetic oligonucleotide
ttttgatatgacaattgctt

SEQ ID NO: 3232 - DNA, 20 bp, Artificial sequence
  Synthetic oligonucleotide
gttttgatatgacaattgct

SEQ ID NO: 3233 - DNA, 20 bp, Artificial sequence
  Synthetic oligonucleotide
tgttttgatatgacaattgc

SEQ ID NO: 3234 - DNA, 20 bp, Artificial sequence
  Synthetic oligonucleotide
gtgttttgatatgacaattg

SEQ ID NO: 3235 - DNA, 20 bp, Artificial sequence
  Synthetic oligonucleotide
tgtgttttgatatgacaatt

SEQ ID NO: 3236 - DNA, 20 bp, Artificial sequence
  Synthetic oligonucleotide
ctgtgttttgatatgacaat

SEQ ID NO: 3237 - DNA, 20 bp, Artificial sequence
  Synthetic oligonucleotide
gctgtgttttgatatgacaa

SEQ ID NO: 3238 - DNA, 20 bp, Artificial sequence
  Synthetic oligonucleotide
tgctgtgttttgatatgaca

SEQ ID NO: 3239 - DNA, 20 bp, Artificial sequence
  Synthetic oligonucleotide
atgctgtgttttgatatgac

SEQ ID NO: 3240 - DNA, 20 bp, Artificial sequence
  Synthetic oligonucleotide
tatgctgtgttttgatatga

SEQ ID NO: 3241 - DNA, 20 bp, Artificial sequence
  Synthetic oligonucleotide
gtatgctgtgttttgatatg

SEQ ID NO: 3242 - DNA, 20 bp, Artificial sequence
  Synthetic oligonucleotide
tgtatgctgtgttttgatat

SEQ ID NO: 3243 - DNA, 20 bp, Artificial sequence
  Synthetic oligonucleotide
atgtatgctgtgttttgata

SEQ ID NO: 3244 - DNA, 20 bp, Artificial sequence
  Synthetic oligonucleotide
tatgtatgctgtgttttgat

SEQ ID NO: 3245 - DNA, 20 bp, Artificial sequence
  Synthetic oligonucleotide
gtatgtatgctgtgttttga

SEQ ID NO: 3246 - DNA, 20 bp, Artificial sequence
  Synthetic oligonucleotide
cgtatgtatgctgtgttttg

SEQ ID NO: 3247 - DNA, 20 bp, Artificial sequence
  Synthetic oligonucleotide
acgtatgtatgctgtgtttt

SEQ ID NO: 3248 - DNA, 20 bp, Artificial sequence
  Synthetic oligonucleotide
aacgtatgtatgctgtgttt

SEQ ID NO: 3249 - DNA, 20 bp, Artificial sequence
  Synthetic oligonucleotide
gaacgtatgtatgctgtgtt

SEQ ID NO: 3250 - DNA, 20 bp, Artificial sequence
  Synthetic oligonucleotide
tgaacgtatgtatgctgtgt

SEQ ID NO: 3251 - DNA, 20 bp, Artificial sequence
  Synthetic oligonucleotide
ttgaacgtatgtatgctgtg

SEQ ID NO: 3252 - DNA, 20 bp, Artificial sequence
  Synthetic oligonucleotide
gttgaacgtatgtatgctgt

SEQ ID NO: 3253 - DNA, 20 bp, Artificial sequence
  Synthetic oligonucleotide
ggttgaacgtatgtatgctg

SEQ ID NO: 3254 - DNA, 20 bp, Artificial sequence
  Synthetic oligonucleotide
aggttgaacgtatgtatgct

SEQ ID NO: 3255 - DNA, 20 bp, Artificial sequence
  Synthetic oligonucleotide
taggttgaacgtatgtatgc

SEQ ID NO: 3256 - DNA, 20 bp, Artificial sequence
  Synthetic oligonucleotide
ttaggttgaacgtatgtatg

SEQ ID NO: 3257 - DNA, 20 bp, Artificial sequence
  Synthetic oligonucleotide
gttaggttgaacgtatgtat

SEQ ID NO: 3258 - DNA, 20 bp, Artificial sequence
  Synthetic oligonucleotide
ggttaggttgaacgtatgta

SEQ ID NO: 3259 - DNA, 20 bp, Artificial sequence
  Synthetic oligonucleotide
tggttaggttgaacgtatgt

SEQ ID NO: 3260 - DNA, 20 bp, Artificial sequence
  Synthetic oligonucleotide
ttggttaggttgaacgtatg

SEQ ID NO: 3261 - DNA, 20 bp, Artificial sequence
  Synthetic oligonucleotide
tttggttaggttgaacgtat

SEQ ID NO: 3262 - DNA, 20 bp, Artificial sequence
  Synthetic oligonucleotide
atttggttaggttgaacgta

SEQ ID NO: 3263 - DNA, 20 bp, Artificial sequence
  Synthetic oligonucleotide
tatttggttaggttgaacgt

SEQ ID NO: 3264 - DNA, 20 bp, Artificial sequence
  Synthetic oligonucleotide
atatttggttaggttgaacg

SEQ ID NO: 3265 - DNA, 20 bp, Artificial sequence
  Synthetic oligonucleotide
gatatttggttaggttgaac

SEQ ID NO: 3266 - DNA, 20 bp, Artificial sequence
  Synthetic oligonucleotide
agatatttggttaggttgaa

SEQ ID NO: 3267 - DNA, 20 bp, Artificial sequence
  Synthetic oligonucleotide
aagatatttggttaggttga

SEQ ID NO: 3268 - DNA, 20 bp, Artificial sequence
  Synthetic oligonucleotide
aaagatatttggttaggttg

SEQ ID NO: 3269 - DNA, 20 bp, Artificial sequence
  Synthetic oligonucleotide
taaagatatttggttaggtt

SEQ ID NO: 3270 - DNA, 20 bp, Artificial sequence
  Synthetic oligonucleotide
gtaaagatatttggttaggt

SEQ ID NO: 3271 - DNA, 20 bp, Artificial sequence
  Synthetic oligonucleotide
tgtaaagatatttggttagg

SEQ ID NO: 3272 - DNA, 20 bp, Artificial sequence
  Synthetic oligonucleotide
gtgtaaagatatttggttag

SEQ ID NO: 3273 - DNA, 20 bp, Artificial sequence
  Synthetic oligonucleotide
agtgtaaagatatttggtta

SEQ ID NO: 3274 - DNA, 20 bp, Artificial sequence
  Synthetic oligonucleotide
aagtgtaaagatatttggtt

SEQ ID NO: 3275 - DNA, 20 bp, Artificial sequence
  Synthetic oligonucleotide
aaagtgtaaagatatttggt

SEQ ID NO: 3276 - DNA, 20 bp, Artificial sequence
  Synthetic oligonucleotide
aaaagtgtaaagatatttgg

SEQ ID NO: 3277 - DNA, 20 bp, Artificial sequence
  Synthetic oligonucleotide
gaaagaaaaagtgtaaagat

SEQ ID NO: 3278 - DNA, 20 bp, Artificial sequence
  Synthetic oligonucleotide
tgaaagaaaaagtgtaaaga

SEQ ID NO: 3279 - DNA, 20 bp, Artificial sequence
  Synthetic oligonucleotide
ctgaaagaaaaagtgtaaag

SEQ ID NO: 3280 - DNA, 20 bp, Artificial sequence
  Synthetic oligonucleotide
cctgaaagaaaaagtgtaaa

SEQ ID NO: 3281 - DNA, 20 bp, Artificial sequence
  Synthetic oligonucleotide
tcctgaaagaaaaagtgtaa

SEQ ID NO: 3282 - DNA, 20 bp, Artificial sequence
  Synthetic oligonucleotide
ctcctgaaagaaaaagtgta

SEQ ID NO: 3283 - DNA, 20 bp, Artificial sequence
  Synthetic oligonucleotide
tctcctgaaagaaaaagtgt

SEQ ID NO: 3284 - DNA, 20 bp, Artificial sequence
  Synthetic oligonucleotide
gtctcctgaaagaaaaagtg

SEQ ID NO: 3285 - DNA, 20 bp, Artificial sequence
  Synthetic oligonucleotide
tgtctcctgaaagaaaaagt

SEQ ID NO: 3286 - DNA, 20 bp, Artificial sequence
  Synthetic oligonucleotide
ttgtctcctgaaagaaaaag

SEQ ID NO: 3287 - DNA, 20 bp, Artificial sequence
  Synthetic oligonucleotide
cttgtctcctgaaagaaaaa

SEQ ID NO: 3288 - DNA, 20 bp, Artificial sequence
  Synthetic oligonucleotide
ccttgtctcctgaaagaaaa

SEQ ID NO: 3289 - DNA, 20 bp, Artificial sequence
  Synthetic oligonucleotide
cccttgtctcctgaaagaaa

SEQ ID NO: 3290 - DNA, 20 bp, Artificial sequence
  Synthetic oligonucleotide
acccttgtctcctgaaagaa

SEQ ID NO: 3291 - DNA, 20 bp, Artificial sequence
  Synthetic oligonucleotide
aacccttgtctcctgaaaga

SEQ ID NO: 3292 - DNA, 20 bp, Artificial sequence
  Synthetic oligonucleotide
gaacccttgtctcctgaaag

SEQ ID NO: 3293 - DNA, 20 bp, Artificial sequence
  Synthetic oligonucleotide
agaacccttgtctcctgaaa

SEQ ID NO: 3294 - DNA, 20 bp, Artificial sequence
  Synthetic oligonucleotide
aagaacccttgtctcctgaa

SEQ ID NO: 3295 - DNA, 20 bp, Artificial sequence
  Synthetic oligonucleotide
aaagaacccttgtctcctga

SEQ ID NO: 3296 - DNA, 20 bp, Artificial sequence
  Synthetic oligonucleotide
caaagaacccttgtctcctg

SEQ ID NO: 3297 - DNA, 20 bp, Artificial sequence
  Synthetic oligonucleotide
ccaaagaacccttgtctcct

SEQ ID NO: 3298 - DNA, 20 bp, Artificial sequence
  Synthetic oligonucleotide
cccaaagaacccttgtctcc

SEQ ID NO: 3299 - DNA, 20 bp, Artificial sequence
  Synthetic oligonucleotide
acccaaagaacccttgtctc

SEQ ID NO: 3300 - DNA, 20 bp, Artificial sequence
  Synthetic oligonucleotide
gacccaaagaacccttgtct

SEQ ID NO: 3301 - DNA, 20 bp, Artificial sequence
  Synthetic oligonucleotide
ggacccaaagaacccttgtc

SEQ ID NO: 3302 - DNA, 20 bp, Artificial sequence
  Synthetic oligonucleotide
tgaaagggacccaaagaacc

SEQ ID NO: 3303 - DNA, 20 bp, Artificial sequence
  Synthetic oligonucleotide
ttgaaagggacccaaagaac

SEQ ID NO: 3304 - DNA, 20 bp, Artificial sequence
  Synthetic oligonucleotide
tttgaaagggacccaaagaa

SEQ ID NO: 3305 - DNA, 20 bp, Artificial sequence
  Synthetic oligonucleotide
gtttgaaagggacccaaaga

SEQ ID NO: 3306 - DNA, 20 bp, Artificial sequence
  Synthetic oligonucleotide
cgtttgaaagggacccaaag

SEQ ID NO: 3307 - DNA, 20 bp, Artificial sequence
  Synthetic oligonucleotide
ccaagataccgtttgaaagg

SEQ ID NO: 3308 - DNA, 20 bp, Artificial sequence
  Synthetic oligonucleotide
accaagataccgtttgaaag

SEQ ID NO: 3309 - DNA, 20 bp, Artificial sequence
  Synthetic oligonucleotide
caccaagataccgtttgaaa

SEQ ID NO: 3310 - DNA, 20 bp, Artificial sequence
  Synthetic oligonucleotide
acaccaagataccgtttgaa

SEQ ID NO: 3311 - DNA, 20 bp, Artificial sequence
  Synthetic oligonucleotide
aacaccaagataccgtttga

SEQ ID NO: 3312 - DNA, 20 bp, Artificial sequence
  Synthetic oligonucleotide
taacaccaagataccgtttg

SEQ ID NO: 3313 - DNA, 20 bp, Artificial sequence
  Synthetic oligonucleotide
ataacaccaagataccgttt

SEQ ID NO: 3314 - DNA, 20 bp, Artificial sequence
  Synthetic oligonucleotide
aataacaccaagataccgtt

SEQ ID NO: 3315 - DNA, 20 bp, Artificial sequence
  Synthetic oligonucleotide
taataacaccaagataccgt

SEQ ID NO: 3316 - DNA, 20 bp, Artificial sequence
  Synthetic oligonucleotide
gtaataacaccaagataccg

SEQ ID NO: 3317 - DNA, 20 bp, Artificial sequence
  Synthetic oligonucleotide
tgtaataacaccaagatacc

SEQ ID NO: 3318 - DNA, 20 bp, Artificial sequence
  Synthetic oligonucleotide
atgtaataacaccaagatac

SEQ ID NO: 3319 - DNA, 20 bp, Artificial sequence
  Synthetic oligonucleotide
aatgtaataacaccaagata

SEQ ID NO: 3320 - DNA, 20 bp, Artificial sequence
  Synthetic oligonucleotide
taatgtaataacaccaagat

SEQ ID NO: 3321 - DNA, 20 bp, Artificial sequence
  Synthetic oligonucleotide
ataatgtaataacaccaaga

SEQ ID NO: 3322 - DNA, 20 bp, Artificial sequence
  Synthetic oligonucleotide
cataatgtaataacaccaag

SEQ ID NO: 3323 - DNA, 20 bp, Artificial sequence
  Synthetic oligonucleotide
gcataatgtaataacaccaa

SEQ ID NO: 3324 - DNA, 20 bp, Artificial sequence
  Synthetic oligonucleotide
ggcataatgtaataacacca

SEQ ID NO: 3325 - DNA, 20 bp, Artificial sequence
  Synthetic oligonucleotide
aggcataatgtaataacacc

SEQ ID NO: 3326 - DNA, 20 bp, Artificial sequence
  Synthetic oligonucleotide
taggcataatgtaataacac

SEQ ID NO: 3327 - DNA, 20 bp, Artificial sequence
  Synthetic oligonucleotide
gataggcataatgtaataac

SEQ ID NO: 3328 - DNA, 20 bp, Artificial sequence
  Synthetic oligonucleotide
agataggcataatgtaataa

SEQ ID NO: 3329 - DNA, 20 bp, Artificial sequence
  Synthetic oligonucleotide
tagataggcataatgtaata

SEQ ID NO: 3330 - DNA, 20 bp, Artificial sequence
  Synthetic oligonucleotide
atagataggcataatgtaat

SEQ ID NO: 3331 - DNA, 20 bp, Artificial sequence
  Synthetic oligonucleotide
aatagataggcataatgtaa

SEQ ID NO: 3332 - DNA, 20 bp, Artificial sequence
  Synthetic oligonucleotide
caatagataggcataatgta

SEQ ID NO: 3333 - DNA, 20 bp, Artificial sequence
  Synthetic oligonucleotide
gcaatagataggcataatgt

SEQ ID NO: 3334 - DNA, 20 bp, Artificial sequence
  Synthetic oligonucleotide
ggcaatagataggcataatg

SEQ ID NO: 3335 - DNA, 20 bp, Artificial sequence
  Synthetic oligonucleotide
gggcaatagataggcataat

SEQ ID NO: 3336 - DNA, 20 bp, Artificial sequence
  Synthetic oligonucleotide
agggcaatagataggcataa

SEQ ID NO: 3337 - DNA, 20 bp, Artificial sequence
  Synthetic oligonucleotide
aagggcaatagataggcata

SEQ ID NO: 3338 - DNA, 20 bp, Artificial sequence
  Synthetic oligonucleotide
taagggcaatagataggcat

SEQ ID NO: 3339 - DNA, 20 bp, Artificial sequence
  Synthetic oligonucleotide
ataagggcaatagataggca

SEQ ID NO: 3340 - DNA, 20 bp, Artificial sequence
  Synthetic oligonucleotide
tataagggcaatagataggc

SEQ ID NO: 3341 - DNA, 20 bp, Artificial sequence
  Synthetic oligonucleotide
ttataagggcaatagatagg

SEQ ID NO: 3342 - DNA, 20 bp, Artificial sequence
  Synthetic oligonucleotide
attataagggcaatagatag

SEQ ID NO: 3343 - DNA, 20 bp, Artificial sequence
  Synthetic oligonucleotide
tattataagggcaatagata

SEQ ID NO: 3344 - DNA, 20 bp, Artificial sequence
  Synthetic oligonucleotide
atattataagggcaatagat

SEQ ID NO: 3345 - DNA, 20 bp, Artificial sequence
  Synthetic oligonucleotide
gatattataagggcaataga

SEQ ID NO: 3346 - DNA, 20 bp, Artificial sequence
  Synthetic oligonucleotide
tgatattataagggcaatag

SEQ ID NO: 3347 - DNA, 20 bp, Artificial sequence
  Synthetic oligonucleotide
gtgatattataagggcaata

SEQ ID NO: 3348 - DNA, 20 bp, Artificial sequence
  Synthetic oligonucleotide
agtgatattataagggcaat

SEQ ID NO: 3349 - DNA, 20 bp, Artificial sequence
  Synthetic oligonucleotide
aagtgatattataagggcaa

SEQ ID NO: 3350 - DNA, 20 bp, Artificial sequence
  Synthetic oligonucleotide
caagtgatattataagggca

SEQ ID NO: 3351 - DNA, 20 bp, Artificial sequence
  Synthetic oligonucleotide
ccaagtgatattataagggc

SEQ ID NO: 3352 - DNA, 20 bp, Artificial sequence
  Synthetic oligonucleotide
cccaagtgatattataaggg

SEQ ID NO: 3353 - DNA, 20 bp, Artificial sequence
  Synthetic oligonucleotide
tcccaagtgatattataagg

SEQ ID NO: 3354 - DNA, 20 bp, Artificial sequence
  Synthetic oligonucleotide
gtcccaagtgatattataag

SEQ ID NO: 3355 - DNA, 20 bp, Artificial sequence
  Synthetic oligonucleotide
ggtcccaagtgatattataa

SEQ ID NO: 3356 - DNA, 20 bp, Artificial sequence
  Synthetic oligonucleotide
tggtcccaagtgatattata

SEQ ID NO: 3357 - DNA, 20 bp, Artificial sequence
  Synthetic oligonucleotide
ctggtcccaagtgatattat

SEQ ID NO: 3358 - DNA, 20 bp, Artificial sequence
  Synthetic oligonucleotide
cctggtcccaagtgatatta

SEQ ID NO: 3359 - DNA, 20 bp, Artificial sequence
  Synthetic oligonucleotide
tcctggtcccaagtgatatt

SEQ ID NO: 3360 - DNA, 20 bp, Artificial sequence
  Synthetic oligonucleotide
gtcctggtcccaagtgatat

SEQ ID NO: 3361 - DNA, 20 bp, Artificial sequence
  Synthetic oligonucleotide
agtcctggtcccaagtgata

SEQ ID NO: 3362 - DNA, 20 bp, Artificial sequence
  Synthetic oligonucleotide
cagtcctggtcccaagtgat

SEQ ID NO: 3363 - DNA, 20 bp, Artificial sequence
  Synthetic oligonucleotide
tcagtcctggtcccaagtga

SEQ ID NO: 3364 - DNA, 20 bp, Artificial sequence
  Synthetic oligonucleotide
atcagtcctggtcccaagtg

SEQ ID NO: 3365 - DNA, 20 bp, Artificial sequence
  Synthetic oligonucleotide
gatcagtcctggtcccaagt

SEQ ID NO: 3366 - DNA, 20 bp, Artificial sequence
  Synthetic oligonucleotide
acgatcagtcctggtcccaa

SEQ ID NO: 3367 - DNA, 20 bp, Artificial sequence
  Synthetic oligonucleotide
aacgatcagtcctggtccca

SEQ ID NO: 3368 - DNA, 20 bp, Artificial sequence
  Synthetic oligonucleotide
agaacgatcagtcctggtcc

SEQ ID NO: 3369 - DNA, 20 bp, Artificial sequence
  Synthetic oligonucleotide
cagaacgatcagtcctggtc

SEQ ID NO: 3370 - DNA, 20 bp, Artificial sequence
  Synthetic oligonucleotide
gcagaacgatcagtcctggt

SEQ ID NO: 3371 - DNA, 20 bp, Artificial sequence
  Synthetic oligonucleotide
tgcagaacgatcagtcctgg

SEQ ID NO: 3372 - DNA, 20 bp, Artificial sequence
  Synthetic oligonucleotide
ttgcagaacgatcagtcctg

SEQ ID NO: 3373 - DNA, 20 bp, Artificial sequence
  Synthetic oligonucleotide
tttgcagaacgatcagtcct

SEQ ID NO: 3374 - DNA, 20 bp, Artificial sequence
  Synthetic oligonucleotide
atttgcagaacgatcagtcc

SEQ ID NO: 3375 - DNA, 20 bp, Artificial sequence
  Synthetic oligonucleotide
catttgcagaacgatcagtc

SEQ ID NO: 3376 - DNA, 20 bp, Artificial sequence
  Synthetic oligonucleotide
atggcataacaagcatttgc

SEQ ID NO: 3377 - DNA, 20 bp, Artificial sequence
  Synthetic oligonucleotide
gaatggcataacaagcattt

SEQ ID NO: 3378 - DNA, 20 bp, Artificial sequence
  Synthetic oligonucleotide
agaatggcataacaagcatt

SEQ ID NO: 3379 - DNA, 20 bp, Artificial sequence
  Synthetic oligonucleotide
gagaatggcataacaagcat

SEQ ID NO: 3380 - DNA, 20 bp, Artificial sequence
  Synthetic oligonucleotide
tgagaatggcataacaagca

SEQ ID NO: 3381 - DNA, 20 bp, Artificial sequence
  Synthetic oligonucleotide
ttgagaatggcataacaagc

SEQ ID NO: 3382 - DNA, 20 bp, Artificial sequence
  Synthetic oligonucleotide
attgagaatggcataacaag

SEQ ID NO: 3383 - DNA, 20 bp, Artificial sequence
  Synthetic oligonucleotide
gattgagaatggcataacaa

SEQ ID NO: 3384 - DNA, 20 bp, Artificial sequence
  Synthetic oligonucleotide
agattgagaatggcataaca

SEQ ID NO: 3385 - DNA, 20 bp, Artificial sequence
  Synthetic oligonucleotide
tagattgagaatggcataac

SEQ ID NO: 3386 - DNA, 20 bp, Artificial sequence
  Synthetic oligonucleotide
atagattgagaatggcataa

SEQ ID NO: 3387 - DNA, 20 bp, Artificial sequence
  Synthetic oligonucleotide
aatagattgagaatggcata

SEQ ID NO: 3388 - DNA, 20 bp, Artificial sequence
  Synthetic oligonucleotide
aaatagattgagaatggcat

SEQ ID NO: 3389 - DNA, 20 bp, Artificial sequence
  Synthetic oligonucleotide
aaaatagattgagaatggca

SEQ ID NO: 3390 - DNA, 20 bp, Artificial sequence
  Synthetic oligonucleotide
aaaaatagattgagaatggc

SEQ ID NO: 3391 - DNA, 20 bp, Artificial sequence
  Synthetic oligonucleotide
gaaaaatagattgagaatgg

SEQ ID NO: 3392 - DNA, 20 bp, Artificial sequence
  Synthetic oligonucleotide
ggaaaaatagattgagaatg

SEQ ID NO: 3393 - DNA, 20 bp, Artificial sequence
  Synthetic oligonucleotide
gggaaaaatagattgagaat

SEQ ID NO: 3394 - DNA, 20 bp, Artificial sequence
  Synthetic oligonucleotide
cgggaaaaatagattgagaa

SEQ ID NO: 3395 - DNA, 20 bp, Artificial sequence
  Synthetic oligonucleotide
gcgggaaaaatagattgaga

SEQ ID NO: 3396 - DNA, 20 bp, Artificial sequence
  Synthetic oligonucleotide
tgcgggaaaaatagattgag

SEQ ID NO: 3397 - DNA, 20 bp, Artificial sequence
  Synthetic oligonucleotide
gtgcgggaaaaatagattga

SEQ ID NO: 3398 - DNA, 20 bp, Artificial sequence
  Synthetic oligonucleotide
ggtgcgggaaaaatagattg

SEQ ID NO: 3399 - DNA, 20 bp, Artificial sequence
  Synthetic oligonucleotide
aggtgcgggaaaaatagatt

SEQ ID NO: 3400 - DNA, 20 bp, Artificial sequence
  Synthetic oligonucleotide
aaggtgcgggaaaaatagat

SEQ ID NO: 3401 - DNA, 20 bp, Artificial sequence
  Synthetic oligonucleotide
aaaggtgcgggaaaaataga

SEQ ID NO: 3402 - DNA, 20 bp, Artificial sequence
  Synthetic oligonucleotide
aaaaggtgcgggaaaaatag

SEQ ID NO: 3403 - DNA, 20 bp, Artificial sequence
  Synthetic oligonucleotide
gaaaaggtgcgggaaaaata

SEQ ID NO: 3404 - DNA, 20 bp, Artificial sequence
  Synthetic oligonucleotide
tgaaaaggtgcgggaaaaat

SEQ ID NO: 3405 - DNA, 20 bp, Artificial sequence
  Synthetic oligonucleotide
gtgaaaaggtgcgggaaaaa

SEQ ID NO: 3406 - DNA, 20 bp, Artificial sequence
  Synthetic oligonucleotide
tgtgaaaaggtgcgggaaaa

SEQ ID NO: 3407 - DNA, 20 bp, Artificial sequence
  Synthetic oligonucleotide
atgtgaaaaggtgcgggaaa

SEQ ID NO: 3408 - DNA, 20 bp, Artificial sequence
  Synthetic oligonucleotide
catgtgaaaaggtgcgggaa

SEQ ID NO: 3409 - DNA, 20 bp, Artificial sequence
  Synthetic oligonucleotide
tcatgtgaaaaggtgcggga

SEQ ID NO: 3410 - DNA, 20 bp, Artificial sequence
  Synthetic oligonucleotide
atcatgtgaaaaggtgcggg

SEQ ID NO: 3411 - DNA, 20 bp, Artificial sequence
  Synthetic oligonucleotide
aatcatgtgaaaaggtgcgg

SEQ ID NO: 3412 - DNA, 20 bp, Artificial sequence
  Synthetic oligonucleotide
aaatcatgtgaaaaggtgcg

SEQ ID NO: 3413 - DNA, 20 bp, Artificial sequence
  Synthetic oligonucleotide
caaatcatgtgaaaaggtgc

SEQ ID NO: 3414 - DNA, 20 bp, Artificial sequence
  Synthetic oligonucleotide
cctattaaccacaaatcatg

SEQ ID NO: 3415 - DNA, 20 bp, Artificial sequence
  Synthetic oligonucleotide
tcctattaaccacaaatcat

SEQ ID NO: 3416 - DNA, 20 bp, Artificial sequence
  Synthetic oligonucleotide
gtcctattaaccacaaatca

SEQ ID NO: 3417 - DNA, 20 bp, Artificial sequence
  Synthetic oligonucleotide
agtcctattaaccacaaatc

SEQ ID NO: 3418 - DNA, 20 bp, Artificial sequence
  Synthetic oligonucleotide
gagtcctattaaccacaaat

SEQ ID NO: 3419 - DNA, 20 bp, Artificial sequence
  Synthetic oligonucleotide
tgagtcctattaaccacaaa

SEQ ID NO: 3420 - DNA, 20 bp, Artificial sequence
  Synthetic oligonucleotide
ttgagtcctattaaccacaa

SEQ ID NO: 3421 - DNA, 20 bp, Artificial sequence
  Synthetic oligonucleotide
gttgagtcctattaaccaca

SEQ ID NO: 3422 - DNA, 20 bp, Artificial sequence
  Synthetic oligonucleotide
tgttgagtcctattaaccac

SEQ ID NO: 3423 - DNA, 20 bp, Artificial sequence
  Synthetic oligonucleotide
ctgttgagtcctattaacca

SEQ ID NO: 3424 - DNA, 20 bp, Artificial sequence
  Synthetic oligonucleotide
tctgttgagtcctattaacc

SEQ ID NO: 3425 - DNA, 20 bp, Artificial sequence
  Synthetic oligonucleotide
gtctgttgagtcctattaac

SEQ ID NO: 3426 - DNA, 20 bp, Artificial sequence
  Synthetic oligonucleotide
agtctgttgagtcctattaa

SEQ ID NO: 3427 - DNA, 20 bp, Artificial sequence
  Synthetic oligonucleotide
tagtctgttgagtcctatta

SEQ ID NO: 3428 - DNA, 20 bp, Artificial sequence
  Synthetic oligonucleotide
ttagtctgttgagtcctatt

SEQ ID NO: 3429 - DNA, 20 bp, Artificial sequence
  Synthetic oligonucleotide
tttagtctgttgagtcctat

SEQ ID NO: 3430 - DNA, 20 bp, Artificial sequence
  Synthetic oligonucleotide
ttttagtctgttgagtccta

SEQ ID NO: 3431 - DNA, 20 bp, Artificial sequence
  Synthetic oligonucleotide
attttagtctgttgagtcct

SEQ ID NO: 3432 - DNA, 20 bp, Artificial sequence
  Synthetic oligonucleotide
aattttagtctgttgagtcc

SEQ ID NO: 3433 - DNA, 20 bp, Artificial sequence
  Synthetic oligonucleotide
caattttagtctgttgagtc

SEQ ID NO: 3434 - DNA, 20 bp, Artificial sequence
  Synthetic oligonucleotide
gcaattttagtctgttgagt

SEQ ID NO: 3435 - DNA, 20 bp, Artificial sequence
  Synthetic oligonucleotide
tgcaattttagtctgttgag

SEQ ID NO: 3436 - DNA, 20 bp, Artificial sequence
  Synthetic oligonucleotide
atgcaattttagtctgttga

SEQ ID NO: 3437 - DNA, 20 bp, Artificial sequence
  Synthetic oligonucleotide
tatgcaattttagtctgttg

SEQ ID NO: 3438 - DNA, 20 bp, Artificial sequence
  Synthetic oligonucleotide
ctatgcaattttagtctgtt

SEQ ID NO: 3439 - DNA, 20 bp, Artificial sequence
  Synthetic oligonucleotide
actatgcaattttagtctgt

SEQ ID NO: 3440 - DNA, 20 bp, Artificial sequence
  Synthetic oligonucleotide
tactatgcaattttagtctg

SEQ ID NO: 3441 - DNA, 20 bp, Artificial sequence
  Synthetic oligonucleotide
ctactatgcaattttagtct

SEQ ID NO: 3442 - DNA, 20 bp, Artificial sequence
  Synthetic oligonucleotide
tctactatgcaattttagtc

SEQ ID NO: 3443 - DNA, 20 bp, Artificial sequence
  Synthetic oligonucleotide
ttctactatgcaattttagt

SEQ ID NO: 3444 - DNA, 20 bp, Artificial sequence
  Synthetic oligonucleotide
tttctactatgcaattttag

SEQ ID NO: 3445 - DNA, 20 bp, Artificial sequence
  Synthetic oligonucleotide
gcaataaacattaccagctg

SEQ ID NO: 3446 - DNA, 20 bp, Artificial sequence
  Synthetic oligonucleotide
tgcaataaacattaccagct

SEQ ID NO: 3447 - DNA, 20 bp, Artificial sequence
  Synthetic oligonucleotide
ttgcaataaacattaccagc

SEQ ID NO: 3448 - DNA, 20 bp, Artificial sequence
  Synthetic oligonucleotide
gttgcaataaacattaccag

SEQ ID NO: 3449 - DNA, 20 bp, Artificial sequence
  Synthetic oligonucleotide
agttgcaataaacattacca

SEQ ID NO: 3450 - DNA, 20 bp, Artificial sequence
  Synthetic oligonucleotide
cagttgcaataaacattacc

SEQ ID NO: 3451 - DNA, 20 bp, Artificial sequence
  Synthetic oligonucleotide
ccagttgcaataaacattac

SEQ ID NO: 3452 - DNA, 20 bp, Artificial sequence
  Synthetic oligonucleotide
cccagttgcaataaacatta

SEQ ID NO: 3453 - DNA, 20 bp, Artificial sequence
  Synthetic oligonucleotide
ccccagttgcaataaacatt

SEQ ID NO: 3454 - DNA, 20 bp, Artificial sequence
  Synthetic oligonucleotide
accccagttgcaataaacat

SEQ ID NO: 3455 - DNA, 20 bp, Artificial sequence
  Synthetic oligonucleotide
caccccagttgcaataaaca

SEQ ID NO: 3456 - DNA, 20 bp, Artificial sequence
  Synthetic oligonucleotide
gcaccccagttgcaataaac

SEQ ID NO: 3457 - DNA, 20 bp, Artificial sequence
  Synthetic oligonucleotide
agcaccccagttgcaataaa

SEQ ID NO: 3458 - DNA, 20 bp, Artificial sequence
  Synthetic oligonucleotide
tagcaccccagttgcaataa

SEQ ID NO: 3459 - DNA, 20 bp, Artificial sequence
  Synthetic oligonucleotide
atagcaccccagttgcaata

SEQ ID NO: 3460 - DNA, 20 bp, Artificial sequence
  Synthetic oligonucleotide
tatagcaccccagttgcaat

SEQ ID NO: 3461 - DNA, 20 bp, Artificial sequence
  Synthetic oligonucleotide
gtatagcaccccagttgcaa

SEQ ID NO: 3462 - DNA, 20 bp, Artificial sequence
  Synthetic oligonucleotide
tgtatagcaccccagttgca

SEQ ID NO: 3463 - DNA, 20 bp, Artificial sequence
  Synthetic oligonucleotide
ttgtatagcaccccagttgc

SEQ ID NO: 3464 - DNA, 20 bp, Artificial sequence
  Synthetic oligonucleotide
attgtatagcaccccagttg

SEQ ID NO: 3465 - DNA, 20 bp, Artificial sequence
  Synthetic oligonucleotide
aattgtatagcaccccagtt

SEQ ID NO: 3466 - DNA, 20 bp, Artificial sequence
  Synthetic oligonucleotide
taattgtatagcaccccagt

SEQ ID NO: 3467 - DNA, 20 bp, Artificial sequence
  Synthetic oligonucleotide
ctaattgtatagcaccccag

SEQ ID NO: 3468 - DNA, 20 bp, Artificial sequence
  Synthetic oligonucleotide
actaattgtatagcacccca

SEQ ID NO: 3469 - DNA, 20 bp, Artificial sequence
  Synthetic oligonucleotide
tactaattgtatagcacccc

SEQ ID NO: 3470 - DNA, 20 bp, Artificial sequence
  Synthetic oligonucleotide
ttactaattgtatagcaccc

SEQ ID NO: 3471 - DNA, 20 bp, Artificial sequence
  Synthetic oligonucleotide
cttactaattgtatagcacc

SEQ ID NO: 3472 - DNA, 20 bp, Artificial sequence
  Synthetic oligonucleotide
tcttactaattgtatagcac

SEQ ID NO: 3473 - DNA, 20 bp, Artificial sequence
  Synthetic oligonucleotide
atcttactaattgtatagca

SEQ ID NO: 3474 - DNA, 20 bp, Artificial sequence
  Synthetic oligonucleotide
catcttactaattgtatagc

SEQ ID NO: 3475 - DNA, 20 bp, Artificial sequence
  Synthetic oligonucleotide
tcatcttactaattgtatag

SEQ ID NO: 3476 - DNA, 20 bp, Artificial sequence
  Synthetic oligonucleotide
catcatcttactaattgtat

SEQ ID NO: 3477 - DNA, 20 bp, Artificial sequence
  Synthetic oligonucleotide
gcatcatcttactaattgta

SEQ ID NO: 3478 - DNA, 20 bp, Artificial sequence
  Synthetic oligonucleotide
tgcatcatcttactaattgt

SEQ ID NO: 3479 - DNA, 20 bp, Artificial sequence
  Synthetic oligonucleotide
ttgcatcatcttactaattg

SEQ ID NO: 3480 - DNA, 20 bp, Artificial sequence
  Synthetic oligonucleotide
attgcatcatcttactaatt

SEQ ID NO: 3481 - DNA, 20 bp, Artificial sequence
  Synthetic oligonucleotide
cattgcatcatcttactaat

SEQ ID NO: 3482 - DNA, 20 bp, Artificial sequence
  Synthetic oligonucleotide
tcattgcatcatcttactaa

SEQ ID NO: 3483 - DNA, 20 bp, Artificial sequence
  Synthetic oligonucleotide
ctcattgcatcatcttacta

SEQ ID NO: 3484 - DNA, 20 bp, Artificial sequence
  Synthetic oligonucleotide
tctcattgcatcatcttact

SEQ ID NO: 3485 - DNA, 20 bp, Artificial sequence
  Synthetic oligonucleotide
ttctcattgcatcatcttac

SEQ ID NO: 3486 - DNA, 20 bp, Artificial sequence
  Synthetic oligonucleotide
attctcattgcatcatctta

SEQ ID NO: 3487 - DNA, 20 bp, Artificial sequence
  Synthetic oligonucleotide
aattctcattgcatcatctt

SEQ ID NO: 3488 - DNA, 20 bp, Artificial sequence
  Synthetic oligonucleotide
aaattctcattgcatcatct

SEQ ID NO: 3489 - DNA, 20 bp, Artificial sequence
  Synthetic oligonucleotide
gaaattctcattgcatcatc

SEQ ID NO: 3490 - DNA, 20 bp, Artificial sequence
  Synthetic oligonucleotide
agaaattctcattgcatcat

SEQ ID NO: 3491 - DNA, 20 bp, Artificial sequence
  Synthetic oligonucleotide
tagaaattctcattgcatca

SEQ ID NO: 3492 - DNA, 20 bp, Artificial sequence
  Synthetic oligonucleotide
gtagaaattctcattgcatc

SEQ ID NO: 3493 - DNA, 20 bp, Artificial sequence
  Synthetic oligonucleotide
agtagaaattctcattgcat

SEQ ID NO: 3494 - DNA, 20 bp, Artificial sequence
  Synthetic oligonucleotide
aagtagaaattctcattgca

SEQ ID NO: 3495 - DNA, 20 bp, Artificial sequence
  Synthetic oligonucleotide
aaagtagaaattctcattgc

SEQ ID NO: 3496 - DNA, 20 bp, Artificial sequence
  Synthetic oligonucleotide
aaaagtagaaattctcattg

SEQ ID NO: 3497 - DNA, 20 bp, Artificial sequence
  Synthetic oligonucleotide
caaaagtagaaattctcatt

SEQ ID NO: 3498 - DNA, 20 bp, Artificial sequence
  Synthetic oligonucleotide
acaaaagtagaaattctcat

SEQ ID NO: 3499 - DNA, 20 bp, Artificial sequence
  Synthetic oligonucleotide
tacaaaagtagaaattctca

SEQ ID NO: 3500 - DNA, 20 bp, Artificial sequence
  Synthetic oligonucleotide
atacaaaagtagaaattctc

SEQ ID NO: 3501 - DNA, 20 bp, Artificial sequence
  Synthetic oligonucleotide
ggaaatacaaaagtagaaat

SEQ ID NO: 3502 - DNA, 20 bp, Artificial sequence
  Synthetic oligonucleotide
aggaaatacaaaagtagaaa

SEQ ID NO: 3503 - DNA, 20 bp, Artificial sequence
  Synthetic oligonucleotide
caggaaatacaaaagtagaa

SEQ ID NO: 3504 - DNA, 20 bp, Artificial sequence
  Synthetic oligonucleotide
tcaggaaatacaaaagtaga

SEQ ID NO: 3505 - DNA, 20 bp, Artificial sequence
  Synthetic oligonucleotide
gtcaggaaatacaaaagtag

SEQ ID NO: 3506 - DNA, 20 bp, Artificial sequence
  Synthetic oligonucleotide
ggtcaggaaatacaaaagta

SEQ ID NO: 3507 - DNA, 20 bp, Artificial sequence
  Synthetic oligonucleotide
tggtcaggaaatacaaaagt

SEQ ID NO: 3508 - DNA, 20 bp, Artificial sequence
  Synthetic oligonucleotide
ctggtcaggaaatacaaaag

SEQ ID NO: 3509 - DNA, 20 bp, Artificial sequence
  Synthetic oligonucleotide
gctggtcaggaaatacaaaa

SEQ ID NO: 3510 - DNA, 20 bp, Artificial sequence
  Synthetic oligonucleotide
ggctggtcaggaaatacaaa

SEQ ID NO: 3511 - DNA, 20 bp, Artificial sequence
  Synthetic oligonucleotide
aggctggtcaggaaatacaa

SEQ ID NO: 3512 - DNA, 20 bp, Artificial sequence
  Synthetic oligonucleotide
caggctggtcaggaaataca

SEQ ID NO: 3513 - DNA, 20 bp, Artificial sequence
  Synthetic oligonucleotide
gcaggctggtcaggaaatac

SEQ ID NO: 3514 - DNA, 20 bp, Artificial sequence
  Synthetic oligonucleotide
agcaggctggtcaggaaata

SEQ ID NO: 3515 - DNA, 20 bp, Artificial sequence
  Synthetic oligonucleotide
taaaagccactttgagcagg

SEQ ID NO: 3516 - DNA, 20 bp, Artificial sequence
  Synthetic oligonucleotide
ataaaagccactttgagcag

SEQ ID NO: 3517 - DNA, 20 bp, Artificial sequence
  Synthetic oligonucleotide
tataaaagccactttgagca

SEQ ID NO: 3518 - DNA, 20 bp, Artificial sequence
  Synthetic oligonucleotide
atataaaagccactttgagc

SEQ ID NO: 3519 - DNA, 20 bp, Artificial sequence
  Synthetic oligonucleotide
gatataaaagccactttgag

SEQ ID NO: 3520 - DNA, 20 bp, Artificial sequence
  Synthetic oligonucleotide
tgatataaaagccactttga

SEQ ID NO: 3521 - DNA, 20 bp, Artificial sequence
  Synthetic oligonucleotide
ttgatataaaagccactttg

SEQ ID NO: 3522 - DNA, 20 bp, Artificial sequence
  Synthetic oligonucleotide
attgatataaaagccacttt

SEQ ID NO: 3523 - DNA, 20 bp, Artificial sequence
  Synthetic oligonucleotide
aattgatataaaagccactt

SEQ ID NO: 3524 - DNA, 20 bp, Artificial sequence
  Synthetic oligonucleotide
caattgatataaaagccact

SEQ ID NO: 3525 - DNA, 20 bp, Artificial sequence
  Synthetic oligonucleotide
tcaattgatataaaagccac

SEQ ID NO: 3526 - DNA, 20 bp, Artificial sequence
  Synthetic oligonucleotide
ttcaattgatataaaagcca

SEQ ID NO: 3527 - DNA, 20 bp, Artificial sequence
  Synthetic oligonucleotide
attcaattgatataaaagcc

SEQ ID NO: 3528 - DNA, 20 bp, Artificial sequence
  Synthetic oligonucleotide
cattcaattgatataaaagc

SEQ ID NO: 3529 - DNA, 20 bp, Artificial sequence
  Synthetic oligonucleotide
ggaaaatcattcaattgata

SEQ ID NO: 3530 - DNA, 20 bp, Artificial sequence
  Synthetic oligonucleotide
aggaaaatcattcaattgat

SEQ ID NO: 3531 - DNA, 20 bp, Artificial sequence
  Synthetic oligonucleotide
gaggaaaatcattcaattga

SEQ ID NO: 3532 - DNA, 20 bp, Artificial sequence
  Synthetic oligonucleotide
tgaggaaaatcattcaattg

SEQ ID NO: 3533 - DNA, 20 bp, Artificial sequence
  Synthetic oligonucleotide
atgaggaaaatcattcaatt

SEQ ID NO: 3534 - DNA, 20 bp, Artificial sequence
  Synthetic oligonucleotide
ttggtttcctgtattaaaaa

SEQ ID NO: 3535 - DNA, 20 bp, Artificial sequence
  Synthetic oligonucleotide
attggtttcctgtattaaaa

SEQ ID NO: 3536 - DNA, 20 bp, Artificial sequence
  Synthetic oligonucleotide
aattggtttcctgtattaaa

SEQ ID NO: 3537 - DNA, 20 bp, Artificial sequence
  Synthetic oligonucleotide
gaattggtttcctgtattaa

SEQ ID NO: 3538 - DNA, 20 bp, Artificial sequence
  Synthetic oligonucleotide
cgaattggtttcctgtatta

SEQ ID NO: 3539 - DNA, 20 bp, Artificial sequence
  Synthetic oligonucleotide
acgaattggtttcctgtatt

SEQ ID NO: 3540 - DNA, 20 bp, Artificial sequence
  Synthetic oligonucleotide
cacgaattggtttcctgtat

SEQ ID NO: 3541 - DNA, 20 bp, Artificial sequence
  Synthetic oligonucleotide
gcacgaattggtttcctgta

SEQ ID NO: 3542 - DNA, 20 bp, Artificial sequence
  Synthetic oligonucleotide
agcacgaattggtttcctgt

SEQ ID NO: 3543 - DNA, 20 bp, Artificial sequence
  Synthetic oligonucleotide
gagcacgaattggtttcctg

SEQ ID NO: 3544 - DNA, 20 bp, Artificial sequence
  Synthetic oligonucleotide
tgagcacgaattggtttcct

SEQ ID NO: 3545 - DNA, 20 bp, Artificial sequence
  Synthetic oligonucleotide
atgagcacgaattggtttcc

SEQ ID NO: 3546 - DNA, 20 bp, Artificial sequence
  Synthetic oligonucleotide
catgagcacgaattggtttc

SEQ ID NO: 3547 - DNA, 20 bp, Artificial sequence
  Synthetic oligonucleotide
ccatgagcacgaattggttt

SEQ ID NO: 3548 - DNA, 20 bp, Artificial sequence
  Synthetic oligonucleotide
tccatgagcacgaattggtt

SEQ ID NO: 3549 - DNA, 20 bp, Artificial sequence
  Synthetic oligonucleotide
cttccatgagcacgaattgg

SEQ ID NO: 3550 - DNA, 20 bp, Artificial sequence
  Synthetic oligonucleotide
tcttccatgagcacgaattg

SEQ ID NO: 3551 - DNA, 20 bp, Artificial sequence
  Synthetic oligonucleotide
ttcttccatgagcacgaatt

SEQ ID NO: 3552 - DNA, 20 bp, Artificial sequence
  Synthetic oligonucleotide
tttcttccatgagcacgaat

SEQ ID NO: 3553 - DNA, 20 bp, Artificial sequence
  Synthetic oligonucleotide
ttttcttccatgagcacgaa

SEQ ID NO: 3554 - DNA, 20 bp, Artificial sequence
  Synthetic oligonucleotide
cttttcttccatgagcacga

SEQ ID NO: 3555 - DNA, 20 bp, Artificial sequence
  Synthetic oligonucleotide
acttttcttccatgagcacg

SEQ ID NO: 3556 - DNA, 20 bp, Artificial sequence
  Synthetic oligonucleotide
aacttttcttccatgagcac

SEQ ID NO: 3557 - DNA, 20 bp, Artificial sequence
  Synthetic oligonucleotide
gaacttttcttccatgagca

SEQ ID NO: 3558 - DNA, 20 bp, Artificial sequence
  Synthetic oligonucleotide
attcacttcaaggctgctgg

SEQ ID NO: 3559 - DNA, 20 bp, Artificial sequence
  Synthetic oligonucleotide
gattcacttcaaggctgctg

SEQ ID NO: 3560 - DNA, 20 bp, Artificial sequence
  Synthetic oligonucleotide
agattcacttcaaggctgct

SEQ ID NO: 3561 - DNA, 20 bp, Artificial sequence
  Synthetic oligonucleotide
aagattcacttcaaggctgc

SEQ ID NO: 3562 - DNA, 20 bp, Artificial sequence
  Synthetic oligonucleotide
ttgctcctgtaagattcact

SEQ ID NO: 3563 - DNA, 20 bp, Artificial sequence
  Synthetic oligonucleotide
attgctcctgtaagattcac

SEQ ID NO: 3564 - DNA, 20 bp, Artificial sequence
  Synthetic oligonucleotide
cattgctcctgtaagattca

SEQ ID NO: 3565 - DNA, 20 bp, Artificial sequence
  Synthetic oligonucleotide
tcattgctcctgtaagattc

SEQ ID NO: 3566 - DNA, 20 bp, Artificial sequence
  Synthetic oligonucleotide
ttcattgctcctgtaagatt

SEQ ID NO: 3567 - DNA, 20 bp, Artificial sequence
  Synthetic oligonucleotide
tttcattgctcctgtaagat

SEQ ID NO: 3568 - DNA, 20 bp, Artificial sequence
  Synthetic oligonucleotide
ctttcattgctcctgtaaga

SEQ ID NO: 3569 - DNA, 20 bp, Artificial sequence
  Synthetic oligonucleotide
actttcattgctcctgtaag

SEQ ID NO: 3570 - DNA, 20 bp, Artificial sequence
  Synthetic oligonucleotide
tactttcattgctcctgtaa

SEQ ID NO: 3571 - DNA, 20 bp, Artificial sequence
  Synthetic oligonucleotide
atactttcattgctcctgta

SEQ ID NO: 3572 - DNA, 20 bp, Artificial sequence
  Synthetic oligonucleotide
aatactttcattgctcctgt

SEQ ID NO: 3573 - DNA, 20 bp, Artificial sequence
  Synthetic oligonucleotide
caatactttcattgctcctg

SEQ ID NO: 3574 - DNA, 20 bp, Artificial sequence
  Synthetic oligonucleotide
tgaatgcaatactttcattg

SEQ ID NO: 3575 - DNA, 20 bp, Artificial sequence
  Synthetic oligonucleotide
ctaatgaatgcaatactttc

SEQ ID NO: 3576 - DNA, 20 bp, Artificial sequence
  Synthetic oligonucleotide
gctaatgaatgcaatacttt

SEQ ID NO: 3577 - DNA, 20 bp, Artificial sequence
  Synthetic oligonucleotide
cgctaatgaatgcaatactt

SEQ ID NO: 3578 - DNA, 20 bp, Artificial sequence
  Synthetic oligonucleotide
acgctaatgaatgcaatact

SEQ ID NO: 3579 - DNA, 20 bp, Artificial sequence
  Synthetic oligonucleotide
gacgctaatgaatgcaatac

SEQ ID NO: 3580 - DNA, 20 bp, Artificial sequence
  Synthetic oligonucleotide
agacgctaatgaatgcaata

SEQ ID NO: 3581 - DNA, 20 bp, Artificial sequence
  Synthetic oligonucleotide
cagacgctaatgaatgcaat

SEQ ID NO: 3582 - DNA, 20 bp, Artificial sequence
  Synthetic oligonucleotide
gcagacgctaatgaatgcaa

SEQ ID NO: 3583 - DNA, 20 bp, Artificial sequence
  Synthetic oligonucleotide
ttctctgaaccttctctggg

SEQ ID NO: 3584 - DNA, 20 bp, Artificial sequence
  Synthetic oligonucleotide
tttctctgaaccttctctgg

SEQ ID NO: 3585 - DNA, 20 bp, Artificial sequence
  Synthetic oligonucleotide
ttttctctgaaccttctctg

SEQ ID NO: 3586 - DNA, 20 bp, Artificial sequence
  Synthetic oligonucleotide
gttttctctgaaccttctct

SEQ ID NO: 3587 - DNA, 20 bp, Artificial sequence
  Synthetic oligonucleotide
agtgaaggttttctctgaac

SEQ ID NO: 3588 - DNA, 20 bp, Artificial sequence
  Synthetic oligonucleotide
aagtgaaggttttctctgaa

SEQ ID NO: 3589 - DNA, 20 bp, Artificial sequence
  Synthetic oligonucleotide
caagtgaaggttttctctga

SEQ ID NO: 3590 - DNA, 20 bp, Artificial sequence
  Synthetic oligonucleotide
acaagtgaaggttttctctg

SEQ ID NO: 3591 - DNA, 20 bp, Artificial sequence
  Synthetic oligonucleotide
aacaagtgaaggttttctct

SEQ ID NO: 3592 - DNA, 20 bp, Artificial sequence
  Synthetic oligonucleotide
aaacaagtgaaggttttctc

SEQ ID NO: 3593 - DNA, 20 bp, Artificial sequence
  Synthetic oligonucleotide
cttgaaaacaagtgaaggtt

SEQ ID NO: 3594 - DNA, 20 bp, Artificial sequence
  Synthetic oligonucleotide
ccttgaaaacaagtgaaggt

SEQ ID NO: 3595 - DNA, 20 bp, Artificial sequence
  Synthetic oligonucleotide
cccttgaaaacaagtgaagg

SEQ ID NO: 3596 - DNA, 20 bp, Artificial sequence
  Synthetic oligonucleotide
ccccttgaaaacaagtgaag

SEQ ID NO: 3597 - DNA, 20 bp, Artificial sequence
  Synthetic oligonucleotide
tccccttgaaaacaagtgaa

SEQ ID NO: 3598 - DNA, 20 bp, Artificial sequence
  Synthetic oligonucleotide
atccccttgaaaacaagtga

SEQ ID NO: 3599 - DNA, 20 bp, Artificial sequence
  Synthetic oligonucleotide
gatccccttgaaaacaagtg

SEQ ID NO: 3600 - DNA, 20 bp, Artificial sequence
  Synthetic oligonucleotide
ggatccccttgaaaacaagt

SEQ ID NO: 3601 - DNA, 20 bp, Artificial sequence
  Synthetic oligonucleotide
gtaaatctacaaggatcccc

SEQ ID NO: 3602 - DNA, 20 bp, Artificial sequence
  Synthetic oligonucleotide
cgtaaatctacaaggatccc

SEQ ID NO: 3603 - DNA, 20 bp, Artificial sequence
  Synthetic oligonucleotide
acgtaaatctacaaggatcc

SEQ ID NO: 3604 - DNA, 20 bp, Artificial sequence
  Synthetic oligonucleotide
tacgtaaatctacaaggatc

SEQ ID NO: 3605 - DNA, 20 bp, Artificial sequence
  Synthetic oligonucleotide
ttacgtaaatctacaaggat

SEQ ID NO: 3606 - DNA, 20 bp, Artificial sequence
  Synthetic oligonucleotide
attacgtaaatctacaagga

SEQ ID NO: 3607 - DNA, 20 bp, Artificial sequence
  Synthetic oligonucleotide
aattacgtaaatctacaagg

SEQ ID NO: 3608 - DNA, 20 bp, Artificial sequence
  Synthetic oligonucleotide
caattacgtaaatctacaag

SEQ ID NO: 3609 - DNA, 20 bp, Artificial sequence
  Synthetic oligonucleotide
ccaattacgtaaatctacaa

SEQ ID NO: 3610 - DNA, 20 bp, Artificial sequence
  Synthetic oligonucleotide
tccaattacgtaaatctaca

SEQ ID NO: 3611 - DNA, 20 bp, Artificial sequence
  Synthetic oligonucleotide
ttccaattacgtaaatctac

SEQ ID NO: 3612 - DNA, 20 bp, Artificial sequence
  Synthetic oligonucleotide
attccaattacgtaaatcta

SEQ ID NO: 3613 - DNA, 20 bp, Artificial sequence
  Synthetic oligonucleotide
gattccaattacgtaaatct

SEQ ID NO: 3614 - DNA, 20 bp, Artificial sequence
  Synthetic oligonucleotide
ggattccaattacgtaaatc

SEQ ID NO: 3615 - DNA, 20 bp, Artificial sequence
  Synthetic oligonucleotide
aggattccaattacgtaaat

SEQ ID NO: 3616 - DNA, 20 bp, Artificial sequence
  Synthetic oligonucleotide
caggattccaattacgtaaa

SEQ ID NO: 3617 - DNA, 20 bp, Artificial sequence
  Synthetic oligonucleotide
tcaggattccaattacgtaa

SEQ ID NO: 3618 - DNA, 20 bp, Artificial sequence
  Synthetic oligonucleotide
ttcaggattccaattacgta

SEQ ID NO: 3619 - DNA, 20 bp, Artificial sequence
  Synthetic oligonucleotide
cttcaggattccaattacgt

SEQ ID NO: 3620 - DNA, 20 bp, Artificial sequence
  Synthetic oligonucleotide
tcttcaggattccaattacg

SEQ ID NO: 3621 - DNA, 20 bp, Artificial sequence
  Synthetic oligonucleotide
ttcttcaggattccaattac

SEQ ID NO: 3622 - DNA, 20 bp, Artificial sequence
  Synthetic oligonucleotide
gttcttcaggattccaatta

SEQ ID NO: 3623 - DNA, 20 bp, Artificial sequence
  Synthetic oligonucleotide
tgttcttcaggattccaatt

SEQ ID NO: 3624 - DNA, 20 bp, Artificial sequence
  Synthetic oligonucleotide
tagaagaataaaagccattt

SEQ ID NO: 3625 - DNA, 20 bp, Artificial sequence
  Synthetic oligonucleotide
ttagaagaataaaagccatt

SEQ ID NO: 3626 - DNA, 20 bp, Artificial sequence
  Synthetic oligonucleotide
tttagaagaataaaagccat

SEQ ID NO: 3627 - DNA, 20 bp, Artificial sequence
  Synthetic oligonucleotide
atttagaagaataaaagcca

SEQ ID NO: 3628 - DNA, 20 bp, Artificial sequence
  Synthetic oligonucleotide
tatttagaagaataaaagcc

SEQ ID NO: 3629 - DNA, 20 bp, Artificial sequence
  Synthetic oligonucleotide
gtatttagaagaataaaagc

SEQ ID NO: 3630 - DNA, 20 bp, Artificial sequence
  Synthetic oligonucleotide
cgtttatatgtatttagaag

SEQ ID NO: 3631 - DNA, 20 bp, Artificial sequence
  Synthetic oligonucleotide
ccgtttatatgtatttagaa

SEQ ID NO: 3632 - DNA, 20 bp, Artificial sequence
  Synthetic oligonucleotide
tccgtttatatgtatttaga

SEQ ID NO: 3633 - DNA, 20 bp, Artificial sequence
  Synthetic oligonucleotide
atccgtttatatgtatttag

SEQ ID NO: 3634 - DNA, 20 bp, Artificial sequence
  Synthetic oligonucleotide
catccgtttatatgtattta

SEQ ID NO: 3635 - DNA, 20 bp, Artificial sequence
  Synthetic oligonucleotide
acatccgtttatatgtattt

SEQ ID NO: 3636 - DNA, 20 bp, Artificial sequence
  Synthetic oligonucleotide
aacatccgtttatatgtatt

SEQ ID NO: 3637 - DNA, 20 bp, Artificial sequence
  Synthetic oligonucleotide
ccatctataaaacatccgtt

SEQ ID NO: 3638 - DNA, 20 bp, Artificial sequence
  Synthetic oligonucleotide
cccatctataaaacatccgt

SEQ ID NO: 3639 - DNA, 20 bp, Artificial sequence
  Synthetic oligonucleotide
tcccatctataaaacatccg

SEQ ID NO: 3640 - DNA, 20 bp, Artificial sequence
  Synthetic oligonucleotide
ttcccatctataaaacatcc

SEQ ID NO: 3641 - DNA, 20 bp, Artificial sequence
  Synthetic oligonucleotide
cttcccatctataaaacatc

SEQ ID NO: 3642 - DNA, 20 bp, Artificial sequence
  Synthetic oligonucleotide
tcttcccatctataaaacat

SEQ ID NO: 3643 - DNA, 20 bp, Artificial sequence
  Synthetic oligonucleotide
gtcttcccatctataaaaca

SEQ ID NO: 3644 - DNA, 20 bp, Artificial sequence
  Synthetic oligonucleotide
tgtcttcccatctataaaac

SEQ ID NO: 3645 - DNA, 20 bp, Artificial sequence
  Synthetic oligonucleotide
atgtcttcccatctataaaa

SEQ ID NO: 3646 - DNA, 20 bp, Artificial sequence
  Synthetic oligonucleotide
catgtcttcccatctataaa

SEQ ID NO: 3647 - DNA, 20 bp, Artificial sequence
  Synthetic oligonucleotide
tcatgtcttcccatctataa

SEQ ID NO: 3648 - DNA, 20 bp, Artificial sequence
  Synthetic oligonucleotide
gtcatgtcttcccatctata

SEQ ID NO: 3649 - DNA, 20 bp, Artificial sequence
  Synthetic oligonucleotide
ggtcatgtcttcccatctat

SEQ ID NO: 3650 - DNA, 20 bp, Artificial sequence
  Synthetic oligonucleotide
aggtcatgtcttcccatcta

SEQ ID NO: 3651 - DNA, 20 bp, Artificial sequence
  Synthetic oligonucleotide
aaggtcatgtcttcccatct

SEQ ID NO: 3652 - DNA, 20 bp, Artificial sequence
  Synthetic oligonucleotide
taaggtcatgtcttcccatc

SEQ ID NO: 3653 - DNA, 20 bp, Artificial sequence
  Synthetic oligonucleotide
ctaaggtcatgtcttcccat

SEQ ID NO: 3654 - DNA, 20 bp, Artificial sequence
  Synthetic oligonucleotide
tctaaggtcatgtcttccca

SEQ ID NO: 3655 - DNA, 20 bp, Artificial sequence
  Synthetic oligonucleotide
ttctaaggtcatgtcttccc

SEQ ID NO: 3656 - DNA, 20 bp, Artificial sequence
  Synthetic oligonucleotide
tttctaaggtcatgtcttcc

SEQ ID NO: 3657 - DNA, 20 bp, Artificial sequence
  Synthetic oligonucleotide
ctttctaaggtcatgtcttc

SEQ ID NO: 3658 - DNA, 20 bp, Artificial sequence
  Synthetic oligonucleotide
aaaactctctcctttctaag

SEQ ID NO: 3659 - DNA, 20 bp, Artificial sequence
  Synthetic oligonucleotide
gaaaactctctcctttctaa

SEQ ID NO: 3660 - DNA, 20 bp, Artificial sequence
  Synthetic oligonucleotide
tgaaaactctctcctttcta

SEQ ID NO: 3661 - DNA, 20 bp, Artificial sequence
  Synthetic oligonucleotide
ctgaaaactctctcctttct

SEQ ID NO: 3662 - DNA, 20 bp, Artificial sequence
  Synthetic oligonucleotide
tctgaaaactctctcctttc

SEQ ID NO: 3663 - DNA, 20 bp, Artificial sequence
  Synthetic oligonucleotide
ctctgaaaactctctccttt

SEQ ID NO: 3664 - DNA, 20 bp, Artificial sequence
  Synthetic oligonucleotide
cctctgaaaactctctcctt

SEQ ID NO: 3665 - DNA, 20 bp, Artificial sequence
  Synthetic oligonucleotide
tcctctgaaaactctctcct

SEQ ID NO: 3666 - DNA, 20 bp, Artificial sequence
  Synthetic oligonucleotide
atcctctgaaaactctctcc

SEQ ID NO: 3667 - DNA, 20 bp, Artificial sequence
  Synthetic oligonucleotide
aatcctctgaaaactctctc

SEQ ID NO: 3668 - DNA, 20 bp, Artificial sequence
  Synthetic oligonucleotide
aaatcctctgaaaactctct

SEQ ID NO: 3669 - DNA, 20 bp, Artificial sequence
  Synthetic oligonucleotide
caaatcctctgaaaactctc

SEQ ID NO: 3670 - DNA, 20 bp, Artificial sequence
  Synthetic oligonucleotide
gcaaatcctctgaaaactct

SEQ ID NO: 3671 - DNA, 20 bp, Artificial sequence
  Synthetic oligonucleotide
ggcaaatcctctgaaaactc

SEQ ID NO: 3672 - DNA, 20 bp, Artificial sequence
  Synthetic oligonucleotide
tggcaaatcctctgaaaact

SEQ ID NO: 3673 - DNA, 20 bp, Artificial sequence
  Synthetic oligonucleotide
ctggcaaatcctctgaaaac

SEQ ID NO: 3674 - DNA, 20 bp, Artificial sequence
  Synthetic oligonucleotide
cctggcaaatcctctgaaaa

SEQ ID NO: 3675 - DNA, 20 bp, Artificial sequence
  Synthetic oligonucleotide
gcctggcaaatcctctgaaa

SEQ ID NO: 3676 - DNA, 20 bp, Artificial sequence
  Synthetic oligonucleotide
agcctggcaaatcctctgaa

SEQ ID NO: 3677 - DNA, 20 bp, Artificial sequence
  Synthetic oligonucleotide
cagcctggcaaatcctctga

SEQ ID NO: 3678 - DNA, 20 bp, Artificial sequence
  Synthetic oligonucleotide
acagcctggcaaatcctctg

SEQ ID NO: 3679 - DNA, 20 bp, Artificial sequence
  Synthetic oligonucleotide
gacagcctggcaaatcctct

SEQ ID NO: 3680 - DNA, 20 bp, Artificial sequence
  Synthetic oligonucleotide
tgacagcctggcaaatcctc

SEQ ID NO: 3681 - DNA, 20 bp, Artificial sequence
  Synthetic oligonucleotide
ctgacagcctggcaaatcct

SEQ ID NO: 3682 - DNA, 20 bp, Artificial sequence
  Synthetic oligonucleotide
ttacaactcccaggacagtt

SEQ ID NO: 3683 - DNA, 20 bp, Artificial sequence
  Synthetic oligonucleotide
tttacaactcccaggacagt

SEQ ID NO: 3684 - DNA, 20 bp, Artificial sequence
  Synthetic oligonucleotide
ttttacaactcccaggacag

SEQ ID NO: 3685 - DNA, 20 bp, Artificial sequence
  Synthetic oligonucleotide
tttttacaactcccaggaca

SEQ ID NO: 3686 - DNA, 20 bp, Artificial sequence
  Synthetic oligonucleotide
atttttacaactcccaggac

SEQ ID NO: 3687 - DNA, 20 bp, Artificial sequence
  Synthetic oligonucleotide
gatttttacaactcccagga

SEQ ID NO: 3688 - DNA, 20 bp, Artificial sequence
  Synthetic oligonucleotide
agatttttacaactcccagg

SEQ ID NO: 3689 - DNA, 20 bp, Artificial sequence
  Synthetic oligonucleotide
aagatttttacaactcccag

SEQ ID NO: 3690 - DNA, 20 bp, Artificial sequence
  Synthetic oligonucleotide
aaagatttttacaactccca

SEQ ID NO: 3691 - DNA, 20 bp, Artificial sequence
  Synthetic oligonucleotide
aaaagatttttacaactccc

SEQ ID NO: 3692 - DNA, 20 bp, Artificial sequence
  Synthetic oligonucleotide
taaaagatttttacaactcc

SEQ ID NO: 3693 - DNA, 20 bp, Artificial sequence
  Synthetic oligonucleotide
ccttaaaagatttttacaac

SEQ ID NO: 3694 - DNA, 20 bp, Artificial sequence
  Synthetic oligonucleotide
gccttaaaagatttttacaa

SEQ ID NO: 3695 - DNA, 20 bp, Artificial sequence
  Synthetic oligonucleotide
ggccttaaaagatttttaca

SEQ ID NO: 3696 - DNA, 20 bp, Artificial sequence
  Synthetic oligonucleotide
tggccttaaaagatttttac

SEQ ID NO: 3697 - DNA, 20 bp, Artificial sequence
  Synthetic oligonucleotide
ctggccttaaaagattttta

SEQ ID NO: 3698 - DNA, 20 bp, Artificial sequence
  Synthetic oligonucleotide
tctggccttaaaagattttt

SEQ ID NO: 3699 - DNA, 20 bp, Artificial sequence
  Synthetic oligonucleotide
gtctggccttaaaagatttt

SEQ ID NO: 3700 - DNA, 20 bp, Artificial sequence
  Synthetic oligonucleotide
ggtctggccttaaaagattt

SEQ ID NO: 3701 - DNA, 20 bp, Artificial sequence
  Synthetic oligonucleotide
atccctcaaattggtctggc

SEQ ID NO: 3702 - DNA, 20 bp, Artificial sequence
  Synthetic oligonucleotide
aatccctcaaattggtctgg

SEQ ID NO: 3703 - DNA, 20 bp, Artificial sequence
  Synthetic oligonucleotide
aaatccctcaaattggtctg

SEQ ID NO: 3704 - DNA, 20 bp, Artificial sequence
  Synthetic oligonucleotide
aaaatccctcaaattggtct

SEQ ID NO: 3705 - DNA, 20 bp, Artificial sequence
  Synthetic oligonucleotide
taaaatccctcaaattggtc

SEQ ID NO: 3706 - DNA, 20 bp, Artificial sequence
  Synthetic oligonucleotide
ttaaaatccctcaaattggt

SEQ ID NO: 3707 - DNA, 20 bp, Artificial sequence
  Synthetic oligonucleotide
tttaaaatccctcaaattgg

SEQ ID NO: 3708 - DNA, 20 bp, Artificial sequence
  Synthetic oligonucleotide
ttttaaaatccctcaaattg

SEQ ID NO: 3709 - DNA, 20 bp, Artificial sequence
  Synthetic oligonucleotide
ctttttaaaatccctcaaat

SEQ ID NO: 3710 - DNA, 20 bp, Artificial sequence
  Synthetic oligonucleotide
actttttaaaatccctcaaa

SEQ ID NO: 3711 - DNA, 20 bp, Artificial sequence
  Synthetic oligonucleotide
cactttttaaaatccctcaa

SEQ ID NO: 3712 - DNA, 20 bp, Artificial sequence
  Synthetic oligonucleotide
acactttttaaaatccctca

SEQ ID NO: 3713 - DNA, 20 bp, Artificial sequence
  Synthetic oligonucleotide
gacactttttaaaatccctc

SEQ ID NO: 3714 - DNA, 20 bp, Artificial sequence
  Synthetic oligonucleotide
agacactttttaaaatccct

SEQ ID NO: 3715 - DNA, 20 bp, Artificial sequence
  Synthetic oligonucleotide
gagacactttttaaaatccc

SEQ ID NO: 3716 - DNA, 20 bp, Artificial sequence
  Synthetic oligonucleotide
tgagacactttttaaaatcc

SEQ ID NO: 3717 - DNA, 20 bp, Artificial sequence
  Synthetic oligonucleotide
ctgagacactttttaaaatc

SEQ ID NO: 3718 - DNA, 20 bp, Artificial sequence
  Synthetic oligonucleotide
actgagacactttttaaaat

SEQ ID NO: 3719 - DNA, 20 bp, Artificial sequence
  Synthetic oligonucleotide
cactgagacactttttaaaa

SEQ ID NO: 3720 - DNA, 20 bp, Artificial sequence
  Synthetic oligonucleotide
gcactgagacactttttaaa

SEQ ID NO: 3721 - DNA, 20 bp, Artificial sequence
  Synthetic oligonucleotide
ggcactgagacactttttaa

SEQ ID NO: 3722 - DNA, 20 bp, Artificial sequence
  Synthetic oligonucleotide
aggcactgagacacttttta

SEQ ID NO: 3723 - DNA, 20 bp, Artificial sequence
  Synthetic oligonucleotide
tctgaaatcataagaggcac

SEQ ID NO: 3724 - DNA, 20 bp, Artificial sequence
  Synthetic oligonucleotide
ttctgaaatcataagaggca

SEQ ID NO: 3725 - DNA, 20 bp, Artificial sequence
  Synthetic oligonucleotide
cttctgaaatcataagaggc

SEQ ID NO: 3726 - DNA, 20 bp, Artificial sequence
  Synthetic oligonucleotide
ccttctgaaatcataagagg

SEQ ID NO: 3727 - DNA, 20 bp, Artificial sequence
  Synthetic oligonucleotide
accttctgaaatcataagag

SEQ ID NO: 3728 - DNA, 20 bp, Artificial sequence
  Synthetic oligonucleotide
aaccttctgaaatcataaga

SEQ ID NO: 3729 - DNA, 20 bp, Artificial sequence
  Synthetic oligonucleotide
aaaccttctgaaatcataag

SEQ ID NO: 3730 - DNA, 20 bp, Artificial sequence
  Synthetic oligonucleotide
aaaaccttctgaaatcataa

SEQ ID NO: 3731 - DNA, 20 bp, Artificial sequence
  Synthetic oligonucleotide
caaaaccttctgaaatcata

SEQ ID NO: 3732 - DNA, 20 bp, Artificial sequence
  Synthetic oligonucleotide
gcaaaaccttctgaaatcat

SEQ ID NO: 3733 - DNA, 20 bp, Artificial sequence
  Synthetic oligonucleotide
agcaaaaccttctgaaatca

SEQ ID NO: 3734 - DNA, 20 bp, Artificial sequence
  Synthetic oligonucleotide
tagcaaaaccttctgaaatc

SEQ ID NO: 3735 - DNA, 20 bp, Artificial sequence
  Synthetic oligonucleotide
atagcaaaaccttctgaaat

SEQ ID NO: 3736 - DNA, 20 bp, Artificial sequence
  Synthetic oligonucleotide
tatagcaaaaccttctgaaa

SEQ ID NO: 3737 - DNA, 20 bp, Artificial sequence
  Synthetic oligonucleotide
atatagcaaaaccttctgaa

SEQ ID NO: 3738 - DNA, 20 bp, Artificial sequence
  Synthetic oligonucleotide
catatagcaaaaccttctga

SEQ ID NO: 3739 - DNA, 20 bp, Artificial sequence
  Synthetic oligonucleotide
acatatagcaaaaccttctg

SEQ ID NO: 3740 - DNA, 20 bp, Artificial sequence
  Synthetic oligonucleotide
tacatatagcaaaaccttct

SEQ ID NO: 3741 - DNA, 20 bp, Artificial sequence
  Synthetic oligonucleotide
ttacatatagcaaaaccttc

SEQ ID NO: 3742 - DNA, 20 bp, Artificial sequence
  Synthetic oligonucleotide
attacatatagcaaaacctt

SEQ ID NO: 3743 - DNA, 20 bp, Artificial sequence
  Synthetic oligonucleotide
gattacatatagcaaaacct

SEQ ID NO: 3744 - DNA, 20 bp, Artificial sequence
  Synthetic oligonucleotide
ggattacatatagcaaaacc

SEQ ID NO: 3745 - DNA, 20 bp, Artificial sequence
  Synthetic oligonucleotide
gggattacatatagcaaaac

SEQ ID NO: 3746 - DNA, 20 bp, Artificial sequence
  Synthetic oligonucleotide
tgggattacatatagcaaaa

SEQ ID NO: 3747 - DNA, 20 bp, Artificial sequence
  Synthetic oligonucleotide
ttgggattacatatagcaaa

SEQ ID NO: 3748 - DNA, 20 bp, Artificial sequence
  Synthetic oligonucleotide
gttgggattacatatagcaa

SEQ ID NO: 3749 - DNA, 20 bp, Artificial sequence
  Synthetic oligonucleotide
agttgggattacatatagca

SEQ ID NO: 3750 - DNA, 20 bp, Artificial sequence
  Synthetic oligonucleotide
tagttgggattacatatagc

SEQ ID NO: 3751 - DNA, 20 bp, Artificial sequence
  Synthetic oligonucleotide
gtagttgggattacatatag

SEQ ID NO: 3752 - DNA, 20 bp, Artificial sequence
  Synthetic oligonucleotide
agtagttgggattacatata

SEQ ID NO: 3753 - DNA, 20 bp, Artificial sequence
  Synthetic oligonucleotide
cagtagttgggattacatat

SEQ ID NO: 3754 - DNA, 20 bp, Artificial sequence
  Synthetic oligonucleotide
acagtagttgggattacata

SEQ ID NO: 3755 - DNA, 20 bp, Artificial sequence
  Synthetic oligonucleotide
aacagtagttgggattacat

SEQ ID NO: 3756 - DNA, 20 bp, Artificial sequence
  Synthetic oligonucleotide
aaacagtagttgggattaca

SEQ ID NO: 3757 - DNA, 20 bp, Artificial sequence
  Synthetic oligonucleotide
aaaacagtagttgggattac

SEQ ID NO: 3758 - DNA, 20 bp, Artificial sequence
  Synthetic oligonucleotide
gaaaacagtagttgggatta

SEQ ID NO: 3759 - DNA, 20 bp, Artificial sequence
  Synthetic oligonucleotide
agaaaacagtagttgggatt

SEQ ID NO: 3760 - DNA, 20 bp, Artificial sequence
  Synthetic oligonucleotide
aagaaaacagtagttgggat

SEQ ID NO: 3761 - DNA, 20 bp, Artificial sequence
  Synthetic oligonucleotide
caagaaaacagtagttggga

SEQ ID NO: 3762 - DNA, 20 bp, Artificial sequence
  Synthetic oligonucleotide
tcaagaaaacagtagttggg

SEQ ID NO: 3763 - DNA, 20 bp, Artificial sequence
  Synthetic oligonucleotide
ctcaagaaaacagtagttgg

SEQ ID NO: 3764 - DNA, 20 bp, Artificial sequence
  Synthetic oligonucleotide
tctcaagaaaacagtagttg

SEQ ID NO: 3765 - DNA, 20 bp, Artificial sequence
  Synthetic oligonucleotide
actctcaagaaaacagtagt

SEQ ID NO: 3766 - DNA, 20 bp, Artificial sequence
  Synthetic oligonucleotide
tactctcaagaaaacagtag

SEQ ID NO: 3767 - DNA, 20 bp, Artificial sequence
  Synthetic oligonucleotide
ctactctcaagaaaacagta

SEQ ID NO: 3768 - DNA, 20 bp, Artificial sequence
  Synthetic oligonucleotide
gctactctcaagaaaacagt

SEQ ID NO: 3769 - DNA, 20 bp, Artificial sequence
  Synthetic oligonucleotide
tgctactctcaagaaaacag

SEQ ID NO: 3770 - DNA, 20 bp, Artificial sequence
  Synthetic oligonucleotide
ctgctactctcaagaaaaca

SEQ ID NO: 3771 - DNA, 20 bp, Artificial sequence
  Synthetic oligonucleotide
tctgctactctcaagaaaac

SEQ ID NO: 3772 - DNA, 20 bp, Artificial sequence
  Synthetic oligonucleotide
ctctgctactctcaagaaaa

SEQ ID NO: 3773 - DNA, 20 bp, Artificial sequence
  Synthetic oligonucleotide
cctctgctactctcaagaaa

SEQ ID NO: 3774 - DNA, 20 bp, Artificial sequence
  Synthetic oligonucleotide
tcctctgctactctcaagaa

SEQ ID NO: 3775 - DNA, 20 bp, Artificial sequence
  Synthetic oligonucleotide
atcctctgctactctcaaga

SEQ ID NO: 3776 - DNA, 20 bp, Artificial sequence
  Synthetic oligonucleotide
aatcctctgctactctcaag

SEQ ID NO: 3777 - DNA, 20 bp, Artificial sequence
  Synthetic oligonucleotide
taatcctctgctactctcaa

SEQ ID NO: 3778 - DNA, 20 bp, Artificial sequence
  Synthetic oligonucleotide
ctaatcctctgctactctca

SEQ ID NO: 3779 - DNA, 20 bp, Artificial sequence
  Synthetic oligonucleotide
tctaatcctctgctactctc

SEQ ID NO: 3780 - DNA, 20 bp, Artificial sequence
  Synthetic oligonucleotide
ttctaatcctctgctactct

SEQ ID NO: 3781 - DNA, 20 bp, Artificial sequence
  Synthetic oligonucleotide
tttctaatcctctgctactc

SEQ ID NO: 3782 - DNA, 20 bp, Artificial sequence
  Synthetic oligonucleotide
ttttctaatcctctgctact

SEQ ID NO: 3783 - DNA, 20 bp, Artificial sequence
  Synthetic oligonucleotide
tttttctaatcctctgctac

SEQ ID NO: 3784 - DNA, 20 bp, Artificial sequence
  Synthetic oligonucleotide
ctttttctaatcctctgcta

SEQ ID NO: 3785 - DNA, 20 bp, Artificial sequence
  Synthetic oligonucleotide
actttttctaatcctctgct

SEQ ID NO: 3786 - DNA, 20 bp, Artificial sequence
  Synthetic oligonucleotide
gactttttctaatcctctgc

SEQ ID NO: 3787 - DNA, 20 bp, Artificial sequence
  Synthetic oligonucleotide
ggactttttctaatcctctg

SEQ ID NO: 3788 - DNA, 20 bp, Artificial sequence
  Synthetic oligonucleotide
aggactttttctaatcctct

SEQ ID NO: 3789 - DNA, 20 bp, Artificial sequence
  Synthetic oligonucleotide
tggaggactttttctaatcc

SEQ ID NO: 3790 - DNA, 20 bp, Artificial sequence
  Synthetic oligonucleotide
atggaggactttttctaatc

SEQ ID NO: 3791 - DNA, 20 bp, Artificial sequence
  Synthetic oligonucleotide
tatggaggactttttctaat

SEQ ID NO: 3792 - DNA, 20 bp, Artificial sequence
  Synthetic oligonucleotide
ttatggaggactttttctaa

SEQ ID NO: 3793 - DNA, 20 bp, Artificial sequence
  Synthetic oligonucleotide
tttatggaggactttttcta

SEQ ID NO: 3794 - DNA, 20 bp, Artificial sequence
  Synthetic oligonucleotide
atttatggaggactttttct

SEQ ID NO: 3795 - DNA, 20 bp, Artificial sequence
  Synthetic oligonucleotide
aatttatggaggactttttc

SEQ ID NO: 3796 - DNA, 20 bp, Artificial sequence
  Synthetic oligonucleotide
taatttatggaggacttttt

SEQ ID NO: 3797 - DNA, 20 bp, Artificial sequence
  Synthetic oligonucleotide
ataatttatggaggactttt

SEQ ID NO: 3798 - DNA, 20 bp, Artificial sequence
  Synthetic oligonucleotide
cataatttatggaggacttt

SEQ ID NO: 3799 - DNA, 20 bp, Artificial sequence
  Synthetic oligonucleotide
aggccggttacataatttat

SEQ ID NO: 3800 - DNA, 20 bp, Artificial sequence
  Synthetic oligonucleotide
aaggccggttacataattta

SEQ ID NO: 3801 - DNA, 20 bp, Artificial sequence
  Synthetic oligonucleotide
gaaggccggttacataattt

SEQ ID NO: 3802 - DNA, 20 bp, Artificial sequence
  Synthetic oligonucleotide
ggaaggccggttacataatt

SEQ ID NO: 3803 - DNA, 20 bp, Artificial sequence
  Synthetic oligonucleotide
agtcaggctagtcaggaagg

SEQ ID NO: 3804 - DNA, 20 bp, Artificial sequence
  Synthetic oligonucleotide
gagtcaggctagtcaggaag

SEQ ID NO: 3805 - DNA, 20 bp, Artificial sequence
  Synthetic oligonucleotide
tgagtcaggctagtcaggaa

SEQ ID NO: 3806 - DNA, 20 bp, Artificial sequence
  Synthetic oligonucleotide
ttgagtcaggctagtcagga

SEQ ID NO: 3807 - DNA, 20 bp, Artificial sequence
  Synthetic oligonucleotide
cttgagtcaggctagtcagg

SEQ ID NO: 3808 - DNA, 20 bp, Artificial sequence
  Synthetic oligonucleotide
gcttgagtcaggctagtcag

SEQ ID NO: 3809 - DNA, 20 bp, Artificial sequence
  Synthetic oligonucleotide
tgcttgagtcaggctagtca

SEQ ID NO: 3810 - DNA, 20 bp, Artificial sequence
  Synthetic oligonucleotide
ttgcttgagtcaggctagtc

SEQ ID NO: 3811 - DNA, 20 bp, Artificial sequence
  Synthetic oligonucleotide
attgcttgagtcaggctagt

SEQ ID NO: 3812 - DNA, 20 bp, Artificial sequence
  Synthetic oligonucleotide
cattgcttgagtcaggctag

SEQ ID NO: 3813 - DNA, 20 bp, Artificial sequence
  Synthetic oligonucleotide
acattgcttgagtcaggcta

SEQ ID NO: 3814 - DNA, 20 bp, Artificial sequence
  Synthetic oligonucleotide
tacattgcttgagtcaggct

SEQ ID NO: 3815 - DNA, 20 bp, Artificial sequence
  Synthetic oligonucleotide
ttacattgcttgagtcaggc

SEQ ID NO: 3816 - DNA, 20 bp, Artificial sequence
  Synthetic oligonucleotide
cttacattgcttgagtcagg

SEQ ID NO: 3817 - DNA, 20 bp, Artificial sequence
  Synthetic oligonucleotide
tcttacattgcttgagtcag

SEQ ID NO: 3818 - DNA, 20 bp, Artificial sequence
  Synthetic oligonucleotide
ctcttacattgcttgagtca

SEQ ID NO: 3819 - DNA, 20 bp, Artificial sequence
  Synthetic oligonucleotide
tctcttacattgcttgagtc

SEQ ID NO: 3820 - DNA, 20 bp, Artificial sequence
  Synthetic oligonucleotide
atctcttacattgcttgagt

SEQ ID NO: 3821 - DNA, 20 bp, Artificial sequence
  Synthetic oligonucleotide
tatctcttacattgcttgag

SEQ ID NO: 3822 - DNA, 20 bp, Artificial sequence
  Synthetic oligonucleotide
ttatctcttacattgcttga

SEQ ID NO: 3823 - DNA, 20 bp, Artificial sequence
  Synthetic oligonucleotide
attatctcttacattgcttg

SEQ ID NO: 3824 - DNA, 20 bp, Artificial sequence
  Synthetic oligonucleotide
aattatctcttacattgctt

SEQ ID NO: 3825 - DNA, 20 bp, Artificial sequence
  Synthetic oligonucleotide
taattatctcttacattgct

SEQ ID NO: 3826 - DNA, 20 bp, Artificial sequence
  Synthetic oligonucleotide
ataattatctcttacattgc

SEQ ID NO: 3827 - DNA, 20 bp, Artificial sequence
  Synthetic oligonucleotide
cagaataattatctcttaca

SEQ ID NO: 3828 - DNA, 20 bp, Artificial sequence
  Synthetic oligonucleotide
acagaataattatctcttac

SEQ ID NO: 3829 - DNA, 20 bp, Artificial sequence
  Synthetic oligonucleotide
gaaaacagaataattatctc

SEQ ID NO: 3830 - DNA, 20 bp, Artificial sequence
  Synthetic oligonucleotide
ccacacttataaattatgaa

SEQ ID NO: 3831 - DNA, 20 bp, Artificial sequence
  Synthetic oligonucleotide
cccacacttataaattatga

SEQ ID NO: 3832 - DNA, 20 bp, Artificial sequence
  Synthetic oligonucleotide
ccccacacttataaattatg

SEQ ID NO: 3833 - DNA, 20 bp, Artificial sequence
  Synthetic oligonucleotide
cccccacacttataaattat

SEQ ID NO: 3834 - DNA, 20 bp, Artificial sequence
  Synthetic oligonucleotide
gcccccacacttataaatta

SEQ ID NO: 3835 - DNA, 20 bp, Artificial sequence
  Synthetic oligonucleotide
tgcccccacacttataaatt

SEQ ID NO: 3836 - DNA, 20 bp, Artificial sequence
  Synthetic oligonucleotide
atgcccccacacttataaat

SEQ ID NO: 3837 - DNA, 20 bp, Artificial sequence
  Synthetic oligonucleotide
catgcccccacacttataaa

SEQ ID NO: 3838 - DNA, 20 bp, Artificial sequence
  Synthetic oligonucleotide
gcatgcccccacacttataa

SEQ ID NO: 3839 - DNA, 20 bp, Artificial sequence
  Synthetic oligonucleotide
ggcatgcccccacacttata

SEQ ID NO: 3840 - DNA, 20 bp, Artificial sequence
  Synthetic oligonucleotide
aggttgtttttatgctgagg

SEQ ID NO: 3841 - DNA, 20 bp, Artificial sequence
  Synthetic oligonucleotide
taggttgtttttatgctgag

SEQ ID NO: 3842 - DNA, 20 bp, Artificial sequence
  Synthetic oligonucleotide
ataggttgtttttatgctga

SEQ ID NO: 3843 - DNA, 20 bp, Artificial sequence
  Synthetic oligonucleotide
aataggttgtttttatgctg

SEQ ID NO: 3844 - DNA, 20 bp, Artificial sequence
  Synthetic oligonucleotide
taataggttgtttttatgct

SEQ ID NO: 3845 - DNA, 20 bp, Artificial sequence
  Synthetic oligonucleotide
ctaataggttgtttttatgc

SEQ ID NO: 3846 - DNA, 20 bp, Artificial sequence
  Synthetic oligonucleotide
cctaataggttgtttttatg

SEQ ID NO: 3847 - DNA, 20 bp, Artificial sequence
  Synthetic oligonucleotide
ccctaataggttgtttttat

SEQ ID NO: 3848 - DNA, 20 bp, Artificial sequence
  Synthetic oligonucleotide
tccctaataggttgttttta

SEQ ID NO: 3849 - DNA, 20 bp, Artificial sequence
  Synthetic oligonucleotide
ttccctaataggttgttttt

SEQ ID NO: 3850 - DNA, 20 bp, Artificial sequence
  Synthetic oligonucleotide
tttccctaataggttgtttt

SEQ ID NO: 3851 - DNA, 20 bp, Artificial sequence
  Synthetic oligonucleotide
ttttccctaataggttgttt

SEQ ID NO: 3852 - DNA, 20 bp, Artificial sequence
  Synthetic oligonucleotide
tttttccctaataggttgtt

SEQ ID NO: 3853 - DNA, 20 bp, Artificial sequence
  Synthetic oligonucleotide
atttttccctaataggttgt

SEQ ID NO: 3854 - DNA, 20 bp, Artificial sequence
  Synthetic oligonucleotide
tatttttccctaataggttg

SEQ ID NO: 3855 - DNA, 20 bp, Artificial sequence
  Synthetic oligonucleotide
atatttttccctaataggtt

SEQ ID NO: 3856 - DNA, 20 bp, Artificial sequence
  Synthetic oligonucleotide
gatatttttccctaataggt

SEQ ID NO: 3857 - DNA, 20 bp, Artificial sequence
  Synthetic oligonucleotide
agatatttttccctaatagg

SEQ ID NO: 3858 - DNA, 20 bp, Artificial sequence
  Synthetic oligonucleotide
tagatatttttccctaatag

SEQ ID NO: 3859 - DNA, 20 bp, Artificial sequence
  Synthetic oligonucleotide
ctattagatatttttcccta

SEQ ID NO: 3860 - DNA, 20 bp, Artificial sequence
  Synthetic oligonucleotide
tctattagatatttttccct

SEQ ID NO: 3861 - DNA, 20 bp, Artificial sequence
  Synthetic oligonucleotide
atctattagatatttttccc

SEQ ID NO: 3862 - DNA, 20 bp, Artificial sequence
  Synthetic oligonucleotide
gataaaggtaatctattaga

SEQ ID NO: 3863 - DNA, 20 bp, Artificial sequence
  Synthetic oligonucleotide
cgataaaggtaatctattag

SEQ ID NO: 3864 - DNA, 20 bp, Artificial sequence
  Synthetic oligonucleotide
gcgataaaggtaatctatta

SEQ ID NO: 3865 - DNA, 20 bp, Artificial sequence
  Synthetic oligonucleotide
ggcgataaaggtaatctatt

SEQ ID NO: 3866 - DNA, 20 bp, Artificial sequence
  Synthetic oligonucleotide
aggcgataaaggtaatctat

SEQ ID NO: 3867 - DNA, 20 bp, Artificial sequence
  Synthetic oligonucleotide
caggcgataaaggtaatcta

SEQ ID NO: 3868 - DNA, 20 bp, Artificial sequence
  Synthetic oligonucleotide
acaggcgataaaggtaatct

SEQ ID NO: 3869 - DNA, 20 bp, Artificial sequence
  Synthetic oligonucleotide
aacaggcgataaaggtaatc

SEQ ID NO: 3870 - DNA, 20 bp, Artificial sequence
  Synthetic oligonucleotide
taacaggcgataaaggtaat

SEQ ID NO: 3871 - DNA, 20 bp, Artificial sequence
  Synthetic oligonucleotide
ctaacaggcgataaaggtaa

SEQ ID NO: 3872 - DNA, 20 bp, Artificial sequence
  Synthetic oligonucleotide
cctaacaggcgataaaggta

SEQ ID NO: 3873 - DNA, 20 bp, Artificial sequence
  Synthetic oligonucleotide
ccctaacaggcgataaaggt

SEQ ID NO: 3874 - DNA, 20 bp, Artificial sequence
  Synthetic oligonucleotide
accctaacaggcgataaagg

SEQ ID NO: 3875 - DNA, 20 bp, Artificial sequence
  Synthetic oligonucleotide
aaccctaacaggcgataaag

SEQ ID NO: 3876 - DNA, 20 bp, Artificial sequence
  Synthetic oligonucleotide
aaaccctaacaggcgataaa

SEQ ID NO: 3877 - DNA, 20 bp, Artificial sequence
  Synthetic oligonucleotide
aaaaccctaacaggcgataa

SEQ ID NO: 3878 - DNA, 20 bp, Artificial sequence
  Synthetic oligonucleotide
taaaaccctaacaggcgata

SEQ ID NO: 3879 - DNA, 20 bp, Artificial sequence
  Synthetic oligonucleotide
ataaaaccctaacaggcgat

SEQ ID NO: 3880 - DNA, 20 bp, Artificial sequence
  Synthetic oligonucleotide
cataaaaccctaacaggcga

SEQ ID NO: 3881 - DNA, 20 bp, Artificial sequence
  Synthetic oligonucleotide
acataaaaccctaacaggcg

SEQ ID NO: 3882 - DNA, 20 bp, Artificial sequence
  Synthetic oligonucleotide
aacataaaaccctaacaggc

SEQ ID NO: 3883 - DNA, 20 bp, Artificial sequence
  Synthetic oligonucleotide
caacataaaaccctaacagg

SEQ ID NO: 3884 - DNA, 20 bp, Artificial sequence
  Synthetic oligonucleotide
acaacataaaaccctaacag

SEQ ID NO: 3885 - DNA, 20 bp, Artificial sequence
  Synthetic oligonucleotide
aacaacataaaaccctaaca

SEQ ID NO: 3886 - DNA, 20 bp, Artificial sequence
  Synthetic oligonucleotide
aaacaacataaaaccctaac

SEQ ID NO: 3887 - DNA, 20 bp, Artificial sequence
  Synthetic oligonucleotide
aaaacaacataaaaccctaa

SEQ ID NO: 3888 - DNA, 20 bp, Artificial sequence
  Synthetic oligonucleotide
aaaaacaacataaaacccta

SEQ ID NO: 3889 - DNA, 20 bp, Artificial sequence
  Synthetic oligonucleotide
taaaaacaacataaaaccct

SEQ ID NO: 3890 - DNA, 20 bp, Artificial sequence
  Synthetic oligonucleotide
ttaaaaacaacataaaaccc

SEQ ID NO: 3891 - DNA, 20 bp, Artificial sequence
  Synthetic oligonucleotide
gttaaaaacaacataaaacc

SEQ ID NO: 3892 - DNA, 20 bp, Artificial sequence
  Synthetic oligonucleotide
ctgagttaaaaacaacataa

SEQ ID NO: 3893 - DNA, 20 bp, Artificial sequence
  Synthetic oligonucleotide
tctgagttaaaaacaacata

SEQ ID NO: 3894 - DNA, 20 bp, Artificial sequence
  Synthetic oligonucleotide
atctgagttaaaaacaacat

SEQ ID NO: 3895 - DNA, 20 bp, Artificial sequence
  Synthetic oligonucleotide
catctgagttaaaaacaaca

SEQ ID NO: 3896 - DNA, 20 bp, Artificial sequence
  Synthetic oligonucleotide
gcatctgagttaaaaacaac

SEQ ID NO: 3897 - DNA, 20 bp, Artificial sequence
  Synthetic oligonucleotide
ggcatctgagttaaaaacaa

SEQ ID NO: 3898 - DNA, 20 bp, Artificial sequence
  Synthetic oligonucleotide
tggcatctgagttaaaaaca

SEQ ID NO: 3899 - DNA, 20 bp, Artificial sequence
  Synthetic oligonucleotide
atggcatctgagttaaaaac

SEQ ID NO: 3900 - DNA, 20 bp, Artificial sequence
  Synthetic oligonucleotide
tatggcatctgagttaaaaa

SEQ ID NO: 3901 - DNA, 20 bp, Artificial sequence
  Synthetic oligonucleotide
ttatggcatctgagttaaaa

SEQ ID NO: 3902 - DNA, 20 bp, Artificial sequence
  Synthetic oligonucleotide
cttatggcatctgagttaaa

SEQ ID NO: 3903 - DNA, 20 bp, Artificial sequence
  Synthetic oligonucleotide
tcttatggcatctgagttaa

SEQ ID NO: 3904 - DNA, 20 bp, Artificial sequence
  Synthetic oligonucleotide
ttcttatggcatctgagtta

SEQ ID NO: 3905 - DNA, 20 bp, Artificial sequence
  Synthetic oligonucleotide
gttcttatggcatctgagtt

SEQ ID NO: 3906 - DNA, 20 bp, Artificial sequence
  Synthetic oligonucleotide
tgttcttatggcatctgagt

SEQ ID NO: 3907 - DNA, 20 bp, Artificial sequence
  Synthetic oligonucleotide
ttgttcttatggcatctgag

SEQ ID NO: 3908 - DNA, 20 bp, Artificial sequence
  Synthetic oligonucleotide
tttgttcttatggcatctga

SEQ ID NO: 3909 - DNA, 20 bp, Artificial sequence
  Synthetic oligonucleotide
ctttgttcttatggcatctg

SEQ ID NO: 3910 - DNA, 20 bp, Artificial sequence
  Synthetic oligonucleotide
tctttgttcttatggcatct

SEQ ID NO: 3911 - DNA, 20 bp, Artificial sequence
  Synthetic oligonucleotide
atctttgttcttatggcatc

SEQ ID NO: 3912 - DNA, 20 bp, Artificial sequence
  Synthetic oligonucleotide
tatctttgttcttatggcat

SEQ ID NO: 3913 - DNA, 20 bp, Artificial sequence
  Synthetic oligonucleotide
gtatctttgttcttatggca

SEQ ID NO: 3914 - DNA, 20 bp, Artificial sequence
  Synthetic oligonucleotide
tgtatctttgttcttatggc

SEQ ID NO: 3915 - DNA, 20 bp, Artificial sequence
  Synthetic oligonucleotide
atgtatctttgttcttatgg

SEQ ID NO: 3916 - DNA, 20 bp, Artificial sequence
  Synthetic oligonucleotide
catgtatctttgttcttatg

SEQ ID NO: 3917 - DNA, 20 bp, Artificial sequence
  Synthetic oligonucleotide
acatgtatctttgttcttat

SEQ ID NO: 3918 - DNA, 20 bp, Artificial sequence
  Synthetic oligonucleotide
tacatgtatctttgttctta

SEQ ID NO: 3919 - DNA, 20 bp, Artificial sequence
  Synthetic oligonucleotide
ttacatgtatctttgttctt

SEQ ID NO: 3920 - DNA, 20 bp, Artificial sequence
  Synthetic oligonucleotide
attacatgtatctttgttct

SEQ ID NO: 3921 - DNA, 20 bp, Artificial sequence
  Synthetic oligonucleotide
aattacatgtatctttgttc

SEQ ID NO: 3922 - DNA, 20 bp, Artificial sequence
  Synthetic oligonucleotide
cacaatataggtattaatga

SEQ ID NO: 3923 - DNA, 20 bp, Artificial sequence
  Synthetic oligonucleotide
gcacaatataggtattaatg

SEQ ID NO: 3924 - DNA, 20 bp, Artificial sequence
  Synthetic oligonucleotide
agcacaatataggtattaat

SEQ ID NO: 3925 - DNA, 20 bp, Artificial sequence
  Synthetic oligonucleotide
aagcacaatataggtattaa

SEQ ID NO: 3926 - DNA, 20 bp, Artificial sequence
  Synthetic oligonucleotide
aaagcacaatataggtatta

SEQ ID NO: 3927 - DNA, 20 bp, Artificial sequence
  Synthetic oligonucleotide
taaagcacaatataggtatt

SEQ ID NO: 3928 - DNA, 20 bp, Artificial sequence
  Synthetic oligonucleotide
ttaaagcacaatataggtat

SEQ ID NO: 3929 - DNA, 20 bp, Artificial sequence
  Synthetic oligonucleotide
cttaaagcacaatataggta

SEQ ID NO: 3930 - DNA, 20 bp, Artificial sequence
  Synthetic oligonucleotide
ccttaaagcacaatataggt

SEQ ID NO: 3931 - DNA, 20 bp, Artificial sequence
  Synthetic oligonucleotide
accttaaagcacaatatagg

SEQ ID NO: 3932 - DNA, 20 bp, Artificial sequence
  Synthetic oligonucleotide
aaccttaaagcacaatatag

SEQ ID NO: 3933 - DNA, 20 bp, Artificial sequence
  Synthetic oligonucleotide
aaaccttaaagcacaatata

SEQ ID NO: 3934 - DNA, 20 bp, Artificial sequence
  Synthetic oligonucleotide
taaaccttaaagcacaatat

SEQ ID NO: 3935 - DNA, 20 bp, Artificial sequence
  Synthetic oligonucleotide
gtaaaccttaaagcacaata

SEQ ID NO: 3936 - DNA, 20 bp, Artificial sequence
  Synthetic oligonucleotide
tgtaaaccttaaagcacaat

SEQ ID NO: 3937 - DNA, 20 bp, Artificial sequence
  Synthetic oligonucleotide
ttgtaaaccttaaagcacaa

SEQ ID NO: 3938 - DNA, 20 bp, Artificial sequence
  Synthetic oligonucleotide
tttgtaaaccttaaagcaca

SEQ ID NO: 3939 - DNA, 20 bp, Artificial sequence
  Synthetic oligonucleotide
ttttgtaaaccttaaagcac

SEQ ID NO: 3940 - DNA, 20 bp, Artificial sequence
  Synthetic oligonucleotide
attttgtaaaccttaaagca

SEQ ID NO: 3941 - DNA, 20 bp, Artificial sequence
  Synthetic oligonucleotide
tattttgtaaaccttaaagc

SEQ ID NO: 3942 - DNA, 20 bp, Artificial sequence
  Synthetic oligonucleotide
ctaagataaagtatgagaaa

SEQ ID NO: 3943 - DNA, 20 bp, Artificial sequence
  Synthetic oligonucleotide
actaagataaagtatgagaa

SEQ ID NO: 3944 - DNA, 20 bp, Artificial sequence
  Synthetic oligonucleotide
aactaagataaagtatgaga

SEQ ID NO: 3945 - DNA, 20 bp, Artificial sequence
  Synthetic oligonucleotide
aaactaagataaagtatgag

SEQ ID NO: 3946 - DNA, 20 bp, Artificial sequence
  Synthetic oligonucleotide
ctaaactaagataaagtatg

SEQ ID NO: 3947 - DNA, 20 bp, Artificial sequence
  Synthetic oligonucleotide
gaaactaaactaagataaag

SEQ ID NO: 3948 - DNA, 20 bp, Artificial sequence
  Synthetic oligonucleotide
caagaaactaaactaagata

SEQ ID NO: 3949 - DNA, 20 bp, Artificial sequence
  Synthetic oligonucleotide
tcaagaaactaaactaagat

SEQ ID NO: 3950 - DNA, 20 bp, Artificial sequence
  Synthetic oligonucleotide
gtcaagaaactaaactaaga

SEQ ID NO: 3951 - DNA, 20 bp, Artificial sequence
  Synthetic oligonucleotide
tgtcaagaaactaaactaag

SEQ ID NO: 3952 - DNA, 20 bp, Artificial sequence
  Synthetic oligonucleotide
ctgtcaagaaactaaactaa

SEQ ID NO: 3953 - DNA, 20 bp, Artificial sequence
  Synthetic oligonucleotide
actgtcaagaaactaaacta

SEQ ID NO: 3954 - DNA, 20 bp, Artificial sequence
  Synthetic oligonucleotide
gactgtcaagaaactaaact

SEQ ID NO: 3955 - DNA, 20 bp, Artificial sequence
  Synthetic oligonucleotide
ggactgtcaagaaactaaac

SEQ ID NO: 3956 - DNA, 20 bp, Artificial sequence
  Synthetic oligonucleotide
tggactgtcaagaaactaaa

SEQ ID NO: 3957 - DNA, 20 bp, Artificial sequence
  Synthetic oligonucleotide
atggactgtcaagaaactaa

SEQ ID NO: 3958 - DNA, 20 bp, Artificial sequence
  Synthetic oligonucleotide
catggactgtcaagaaacta

SEQ ID NO: 3959 - DNA, 20 bp, Artificial sequence
  Synthetic oligonucleotide
tcatggactgtcaagaaact

SEQ ID NO: 3960 - DNA, 20 bp, Artificial sequence
  Synthetic oligonucleotide
ctcatggactgtcaagaaac

SEQ ID NO: 3961 - DNA, 20 bp, Artificial sequence
  Synthetic oligonucleotide
cctcatggactgtcaagaaa

SEQ ID NO: 3962 - DNA, 20 bp, Artificial sequence
  Synthetic oligonucleotide
ccaccttacctcatggactg

SEQ ID NO: 3963 - DNA, 20 bp, Artificial sequence
  Synthetic oligonucleotide
accaccttacctcatggact

SEQ ID NO: 3964 - DNA, 20 bp, Artificial sequence
  Synthetic oligonucleotide
taccaccttacctcatggac

SEQ ID NO: 3965 - DNA, 20 bp, Artificial sequence
  Synthetic oligonucleotide
ctaccaccttacctcatgga

SEQ ID NO: 3966 - DNA, 20 bp, Artificial sequence
  Synthetic oligonucleotide
agctaccaccttacctcatg

SEQ ID NO: 3967 - DNA, 20 bp, Artificial sequence
  Synthetic oligonucleotide
aagctaccaccttacctcat

SEQ ID NO: 3968 - DNA, 20 bp, Artificial sequence
  Synthetic oligonucleotide
aaagctaccaccttacctca

SEQ ID NO: 3969 - DNA, 20 bp, Artificial sequence
  Synthetic oligonucleotide
taaagctaccaccttacctc

SEQ ID NO: 3970 - DNA, 20 bp, Artificial sequence
  Synthetic oligonucleotide
ataaagctaccaccttacct

SEQ ID NO: 3971 - DNA, 20 bp, Artificial sequence
  Synthetic oligonucleotide
gataaagctaccaccttacc

SEQ ID NO: 3972 - DNA, 20 bp, Artificial sequence
  Synthetic oligonucleotide
tgataaagctaccaccttac

SEQ ID NO: 3973 - DNA, 20 bp, Artificial sequence
  Synthetic oligonucleotide
gtgataaagctaccacctta

SEQ ID NO: 3974 - DNA, 20 bp, Artificial sequence
  Synthetic oligonucleotide
aaaatggtgataaagctacc

SEQ ID NO: 3975 - DNA, 20 bp, Artificial sequence
  Synthetic oligonucleotide
taaaatggtgataaagctac

SEQ ID NO: 3976 - DNA, 20 bp, Artificial sequence
  Synthetic oligonucleotide
gtaaaatggtgataaagcta

SEQ ID NO: 3977 - DNA, 20 bp, Artificial sequence
  Synthetic oligonucleotide
tgtaaaatggtgataaagct

SEQ ID NO: 3978 - DNA, 20 bp, Artificial sequence
  Synthetic oligonucleotide
ttgtaaaatggtgataaagc

SEQ ID NO: 3979 - DNA, 20 bp, Artificial sequence
  Synthetic oligonucleotide
tttgtaaaatggtgataaag

SEQ ID NO: 3980 - DNA, 20 bp, Artificial sequence
  Synthetic oligonucleotide
ctttgtaaaatggtgataaa

SEQ ID NO: 3981 - DNA, 20 bp, Artificial sequence
  Synthetic oligonucleotide
actttgtaaaatggtgataa

SEQ ID NO: 3982 - DNA, 20 bp, Artificial sequence
  Synthetic oligonucleotide
cactttgtaaaatggtgata

SEQ ID NO: 3983 - DNA, 20 bp, Artificial sequence
  Synthetic oligonucleotide
ccactttgtaaaatggtgat

SEQ ID NO: 3984 - DNA, 20 bp, Artificial sequence
  Synthetic oligonucleotide
cccactttgtaaaatggtga

SEQ ID NO: 3985 - DNA, 20 bp, Artificial sequence
  Synthetic oligonucleotide
tcccactttgtaaaatggtg

SEQ ID NO: 3986 - DNA, 20 bp, Artificial sequence
  Synthetic oligonucleotide
ttcccactttgtaaaatggt

SEQ ID NO: 3987 - DNA, 20 bp, Artificial sequence
  Synthetic oligonucleotide
tttcccactttgtaaaatgg

SEQ ID NO: 3988 - DNA, 20 bp, Artificial sequence
  Synthetic oligonucleotide
gtttcccactttgtaaaatg

SEQ ID NO: 3989 - DNA, 20 bp, Artificial sequence
  Synthetic oligonucleotide
cgtttcccactttgtaaaat

SEQ ID NO: 3990 - DNA, 20 bp, Artificial sequence
  Synthetic oligonucleotide
tcgtttcccactttgtaaaa

SEQ ID NO: 3991 - DNA, 20 bp, Artificial sequence
  Synthetic oligonucleotide
ttcgtttcccactttgtaaa

SEQ ID NO: 3992 - DNA, 20 bp, Artificial sequence
  Synthetic oligonucleotide
cttcgtttcccactttgtaa

SEQ ID NO: 3993 - DNA, 20 bp, Artificial sequence
  Synthetic oligonucleotide
ccttcgtttcccactttgta

SEQ ID NO: 3994 - DNA, 20 bp, Artificial sequence
  Synthetic oligonucleotide
accttcgtttcccactttgt

SEQ ID NO: 3995 - DNA, 20 bp, Artificial sequence
  Synthetic oligonucleotide
aaccttcgtttcccactttg

SEQ ID NO: 3996 - DNA, 20 bp, Artificial sequence
  Synthetic oligonucleotide
gaaccttcgtttcccacttt

SEQ ID NO: 3997 - DNA, 20 bp, Artificial sequence
  Synthetic oligonucleotide
ggaaccttcgtttcccactt

SEQ ID NO: 3998 - DNA, 20 bp, Artificial sequence
  Synthetic oligonucleotide
aggaaccttcgtttcccact

SEQ ID NO: 3999 - DNA, 20 bp, Artificial sequence
  Synthetic oligonucleotide
gaggaaccttcgtttcccac

SEQ ID NO: 4000 - DNA, 20 bp, Artificial sequence
  Synthetic oligonucleotide
agaggaaccttcgtttccca

SEQ ID NO: 4001 - DNA, 20 bp, Artificial sequence
  Synthetic oligonucleotide
aagaggaaccttcgtttccc

SEQ ID NO: 4002 - DNA, 20 bp, Artificial sequence
  Synthetic oligonucleotide
taagaggaaccttcgtttcc

SEQ ID NO: 4003 - DNA, 20 bp, Artificial sequence
  Synthetic oligonucleotide
ctaagaggaaccttcgtttc

SEQ ID NO: 4004 - DNA, 20 bp, Artificial sequence
  Synthetic oligonucleotide
cctaagaggaaccttcgttt

SEQ ID NO: 4005 - DNA, 20 bp, Artificial sequence
  Synthetic oligonucleotide
acaactaggttcctaagagg

SEQ ID NO: 4006 - DNA, 20 bp, Artificial sequence
  Synthetic oligonucleotide
gacaactaggttcctaagag

SEQ ID NO: 4007 - DNA, 20 bp, Artificial sequence
  Synthetic oligonucleotide
tgacaactaggttcctaaga

SEQ ID NO: 4008 - DNA, 20 bp, Artificial sequence
  Synthetic oligonucleotide
gtgacaactaggttcctaag

SEQ ID NO: 4009 - DNA, 20 bp, Artificial sequence
  Synthetic oligonucleotide
ggtgacaactaggttcctaa

SEQ ID NO: 4010 - DNA, 20 bp, Artificial sequence
  Synthetic oligonucleotide
aggtgacaactaggttccta

SEQ ID NO: 4011 - DNA, 20 bp, Artificial sequence
  Synthetic oligonucleotide
aaggtgacaactaggttcct

SEQ ID NO: 4012 - DNA, 20 bp, Artificial sequence
  Synthetic oligonucleotide
aaaggtgacaactaggttcc

SEQ ID NO: 4013 - DNA, 20 bp, Artificial sequence
  Synthetic oligonucleotide
caaaggtgacaactaggttc

SEQ ID NO: 4014 - DNA, 20 bp, Artificial sequence
  Synthetic oligonucleotide
acaaaggtgacaactaggtt

SEQ ID NO: 4015 - DNA, 20 bp, Artificial sequence
  Synthetic oligonucleotide
tacaaaggtgacaactaggt

SEQ ID NO: 4016 - DNA, 20 bp, Artificial sequence
  Synthetic oligonucleotide
atacaaaggtgacaactagg

SEQ ID NO: 4017 - DNA, 20 bp, Artificial sequence
  Synthetic oligonucleotide
tatacaaaggtgacaactag

SEQ ID NO: 4018 - DNA, 20 bp, Artificial sequence
  Synthetic oligonucleotide
ttatacaaaggtgacaacta

SEQ ID NO: 4019 - DNA, 20 bp, Artificial sequence
  Synthetic oligonucleotide
attatacaaaggtgacaact

SEQ ID NO: 4020 - DNA, 20 bp, Artificial sequence
  Synthetic oligonucleotide
tattatacaaaggtgacaac

SEQ ID NO: 4021 - DNA, 20 bp, Artificial sequence
  Synthetic oligonucleotide
ttattatacaaaggtgacaa

SEQ ID NO: 4022 - DNA, 20 bp, Artificial sequence
  Synthetic oligonucleotide
tttattatacaaaggtgaca

SEQ ID NO: 4023 - DNA, 20 bp, Artificial sequence
  Synthetic oligonucleotide
ttttattatacaaaggtgac

SEQ ID NO: 4024 - DNA, 20 bp, Artificial sequence
  Synthetic oligonucleotide
gttttattatacaaaggtga

SEQ ID NO: 4025 - DNA, 20 bp, Artificial sequence
  Synthetic oligonucleotide
agttttattatacaaaggtg

SEQ ID NO: 4026 - DNA, 20 bp, Artificial sequence
  Synthetic oligonucleotide
gaagttttattatacaaagg

SEQ ID NO: 4027 - DNA, 20 bp, Artificial sequence
  Synthetic oligonucleotide
cgaagttttattatacaaag

SEQ ID NO: 4028 - DNA, 20 bp, Artificial sequence
  Synthetic oligonucleotide
cttcgaagttttattataca

SEQ ID NO: 4029 - DNA, 20 bp, Artificial sequence
  Synthetic oligonucleotide
gcttcgaagttttattatac

SEQ ID NO: 4030 - DNA, 20 bp, Artificial sequence
  Synthetic oligonucleotide
agcttcgaagttttattata

SEQ ID NO: 4031 - DNA, 20 bp, Artificial sequence
  Synthetic oligonucleotide
gagcttcgaagttttattat

SEQ ID NO: 4032 - DNA, 20 bp, Artificial sequence
  Synthetic oligonucleotide
aaccagttaacagctccgag

SEQ ID NO: 4033 - DNA, 20 bp, Artificial sequence
  Synthetic oligonucleotide
aaaccagttaacagctccga

SEQ ID NO: 4034 - DNA, 20 bp, Artificial sequence
  Synthetic oligonucleotide
caaaccagttaacagctccg

SEQ ID NO: 4035 - DNA, 20 bp, Artificial sequence
  Synthetic oligonucleotide
gcaaaccagttaacagctcc

SEQ ID NO: 4036 - DNA, 20 bp, Artificial sequence
  Synthetic oligonucleotide
agcaaaccagttaacagctc

SEQ ID NO: 4037 - DNA, 20 bp, Artificial sequence
  Synthetic oligonucleotide
cagcaaaccagttaacagct

SEQ ID NO: 4038 - DNA, 20 bp, Artificial sequence
  Synthetic oligonucleotide
tcagcaaaccagttaacagc

SEQ ID NO: 4039 - DNA, 20 bp, Artificial sequence
  Synthetic oligonucleotide
ttcagcaaaccagttaacag

SEQ ID NO: 4040 - DNA, 20 bp, Artificial sequence
  Synthetic oligonucleotide
cttcagcaaaccagttaaca

SEQ ID NO: 4041 - DNA, 20 bp, Artificial sequence
  Synthetic oligonucleotide
ccttcagcaaaccagttaac

SEQ ID NO: 4042 - DNA, 20 bp, Artificial sequence
  Synthetic oligonucleotide
tcttacagctaagccttcag

SEQ ID NO: 4043 - DNA, 20 bp, Artificial sequence
  Synthetic oligonucleotide
ctcttacagctaagccttca

SEQ ID NO: 4044 - DNA, 20 bp, Artificial sequence
  Synthetic oligonucleotide
tctgaattctggctcttaca

SEQ ID NO: 4045 - DNA, 20 bp, Artificial sequence
  Synthetic oligonucleotide
gtctgaattctggctcttac

SEQ ID NO: 4046 - DNA, 20 bp, Artificial sequence
  Synthetic oligonucleotide
ggtctgaattctggctctta

SEQ ID NO: 4047 - DNA, 20 bp, Artificial sequence
  Synthetic oligonucleotide
gggtctgaattctggctctt

SEQ ID NO: 4048 - DNA, 20 bp, Artificial sequence
  Synthetic oligonucleotide
tgggtctgaattctggctct

SEQ ID NO: 4049 - DNA, 20 bp, Artificial sequence
  Synthetic oligonucleotide
ctgggtctgaattctggctc

SEQ ID NO: 4050 - DNA, 20 bp, Artificial sequence
  Synthetic oligonucleotide
cctgggtctgaattctggct

SEQ ID NO: 4051 - DNA, 20 bp, Artificial sequence
  Synthetic oligonucleotide
acctgggtctgaattctggc

SEQ ID NO: 4052 - DNA, 20 bp, Artificial sequence
  Synthetic oligonucleotide
gcagtttgaagtcactcaga

SEQ ID NO: 4053 - DNA, 20 bp, Artificial sequence
  Synthetic oligonucleotide
tgcagtttgaagtcactcag

SEQ ID NO: 4054 - DNA, 20 bp, Artificial sequence
  Synthetic oligonucleotide
gtgcagtttgaagtcactca

SEQ ID NO: 4055 - DNA, 20 bp, Artificial sequence
  Synthetic oligonucleotide
tgtgcagtttgaagtcactc

SEQ ID NO: 4056 - DNA, 20 bp, Artificial sequence
  Synthetic oligonucleotide
ctgtgcagtttgaagtcact

SEQ ID NO: 4057 - DNA, 20 bp, Artificial sequence
  Synthetic oligonucleotide
actgtgcagtttgaagtcac

SEQ ID NO: 4058 - DNA, 20 bp, Artificial sequence
  Synthetic oligonucleotide
taatgggaaggactgtgcag

SEQ ID NO: 4059 - DNA, 20 bp, Artificial sequence
  Synthetic oligonucleotide
ataatgggaaggactgtgca

SEQ ID NO: 4060 - DNA, 20 bp, Artificial sequence
  Synthetic oligonucleotide
aataatgggaaggactgtgc

SEQ ID NO: 4061 - DNA, 20 bp, Artificial sequence
  Synthetic oligonucleotide
taataatgggaaggactgtg

SEQ ID NO: 4062 - DNA, 20 bp, Artificial sequence
  Synthetic oligonucleotide
gtaataatgggaaggactgt

SEQ ID NO: 4063 - DNA, 20 bp, Artificial sequence
  Synthetic oligonucleotide
ggtaataatgggaaggactg

SEQ ID NO: 4064 - DNA, 20 bp, Artificial sequence
  Synthetic oligonucleotide
gggtaataatgggaaggact

SEQ ID NO: 4065 - DNA, 20 bp, Artificial sequence
  Synthetic oligonucleotide
tgggtaataatgggaaggac

SEQ ID NO: 4066 - DNA, 20 bp, Artificial sequence
  Synthetic oligonucleotide
atgggtaataatgggaagga

SEQ ID NO: 4067 - DNA, 20 bp, Artificial sequence
  Synthetic oligonucleotide
tatgggtaataatgggaagg

SEQ ID NO: 4068 - DNA, 20 bp, Artificial sequence
  Synthetic oligonucleotide
atatgggtaataatgggaag

SEQ ID NO: 4069 - DNA, 20 bp, Artificial sequence
  Synthetic oligonucleotide
catatgggtaataatgggaa

SEQ ID NO: 4070 - DNA, 20 bp, Artificial sequence
  Synthetic oligonucleotide
gcatatgggtaataatggga

SEQ ID NO: 4071 - DNA, 20 bp, Artificial sequence
  Synthetic oligonucleotide
agcatatgggtaataatggg

SEQ ID NO: 4072 - DNA, 20 bp, Artificial sequence
  Synthetic oligonucleotide
tagcatatgggtaataatgg

SEQ ID NO: 4073 - DNA, 20 bp, Artificial sequence
  Synthetic oligonucleotide
atagcatatgggtaataatg

SEQ ID NO: 4074 - DNA, 20 bp, Artificial sequence
  Synthetic oligonucleotide
gatagcatatgggtaataat

SEQ ID NO: 4075 - DNA, 20 bp, Artificial sequence
  Synthetic oligonucleotide
ggatagcatatgggtaataa

SEQ ID NO: 4076 - DNA, 20 bp, Artificial sequence
  Synthetic oligonucleotide
gggatagcatatgggtaata

SEQ ID NO: 4077 - DNA, 20 bp, Artificial sequence
  Synthetic oligonucleotide
agggatagcatatgggtaat

SEQ ID NO: 4078 - DNA, 20 bp, Artificial sequence
  Synthetic oligonucleotide
aagggatagcatatgggtaa

SEQ ID NO: 4079 - DNA, 20 bp, Artificial sequence
  Synthetic oligonucleotide
taagggatagcatatgggta

SEQ ID NO: 4080 - DNA, 20 bp, Artificial sequence
  Synthetic oligonucleotide
ataagggatagcatatgggt

SEQ ID NO: 4081 - DNA, 20 bp, Artificial sequence
  Synthetic oligonucleotide
tataagggatagcatatggg

SEQ ID NO: 4082 - DNA, 20 bp, Artificial sequence
  Synthetic oligonucleotide
atataagggatagcatatgg

SEQ ID NO: 4083 - DNA, 20 bp, Artificial sequence
  Synthetic oligonucleotide
aatataagggatagcatatg

SEQ ID NO: 4084 - DNA, 20 bp, Artificial sequence
  Synthetic oligonucleotide
aaatataagggatagcatat

SEQ ID NO: 4085 - DNA, 20 bp, Artificial sequence
  Synthetic oligonucleotide
aaaatataagggatagcata

SEQ ID NO: 4086 - DNA, 20 bp, Artificial sequence
  Synthetic oligonucleotide
aaaaatataagggatagcat

SEQ ID NO: 4087 - DNA, 20 bp, Artificial sequence
  Synthetic oligonucleotide
taaaaatataagggatagca

SEQ ID NO: 4088 - DNA, 20 bp, Artificial sequence
  Synthetic oligonucleotide
ttaaaaatataagggatagc

SEQ ID NO: 4089 - DNA, 20 bp, Artificial sequence
  Synthetic oligonucleotide
ccaagtttataaatgaatga

SEQ ID NO: 4090 - DNA, 20 bp, Artificial sequence
  Synthetic oligonucleotide
accaagtttataaatgaatg

SEQ ID NO: 4091 - DNA, 20 bp, Artificial sequence
  Synthetic oligonucleotide
caccaagtttataaatgaat

SEQ ID NO: 4092 - DNA, 20 bp, Artificial sequence
  Synthetic oligonucleotide
tcaccaagtttataaatgaa

SEQ ID NO: 4093 - DNA, 20 bp, Artificial sequence
  Synthetic oligonucleotide
atcaccaagtttataaatga

SEQ ID NO: 4094 - DNA, 20 bp, Artificial sequence
  Synthetic oligonucleotide
aatcaccaagtttataaatg

SEQ ID NO: 4095 - DNA, 20 bp, Artificial sequence
  Synthetic oligonucleotide
gaatcaccaagtttataaat

SEQ ID NO: 4096 - DNA, 20 bp, Artificial sequence
  Synthetic oligonucleotide
tgaatcaccaagtttataaa

SEQ ID NO: 4097 - DNA, 20 bp, Artificial sequence
  Synthetic oligonucleotide
gtgaatcaccaagtttataa

SEQ ID NO: 4098 - DNA, 20 bp, Artificial sequence
  Synthetic oligonucleotide
atctaataaaggtgaatcac

SEQ ID NO: 4099 - DNA, 20 bp, Artificial sequence
  Synthetic oligonucleotide
aatctaataaaggtgaatca

SEQ ID NO: 4100 - DNA, 20 bp, Artificial sequence
  Synthetic oligonucleotide
gaatctaataaaggtgaatc

SEQ ID NO: 4101 - DNA, 20 bp, Artificial sequence
  Synthetic oligonucleotide
agaatctaataaaggtgaat

SEQ ID NO: 4102 - DNA, 20 bp, Artificial sequence
  Synthetic oligonucleotide
cagaatctaataaaggtgaa

SEQ ID NO: 4103 - DNA, 20 bp, Artificial sequence
  Synthetic oligonucleotide
ccagaatctaataaaggtga

SEQ ID NO: 4104 - DNA, 20 bp, Artificial sequence
  Synthetic oligonucleotide
accagaatctaataaaggtg

SEQ ID NO: 4105 - DNA, 20 bp, Artificial sequence
  Synthetic oligonucleotide
gaccagaatctaataaaggt

SEQ ID NO: 4106 - DNA, 20 bp, Artificial sequence
  Synthetic oligonucleotide
cgaccagaatctaataaagg

SEQ ID NO: 4107 - DNA, 20 bp, Artificial sequence
  Synthetic oligonucleotide
gcgaccagaatctaataaag

SEQ ID NO: 4108 - DNA, 20 bp, Artificial sequence
  Synthetic oligonucleotide
agcgaccagaatctaataaa

SEQ ID NO: 4109 - DNA, 20 bp, Artificial sequence
  Synthetic oligonucleotide
cagcgaccagaatctaataa

SEQ ID NO: 4110 - DNA, 20 bp, Artificial sequence
  Synthetic oligonucleotide
tcagcgaccagaatctaata

SEQ ID NO: 4111 - DNA, 20 bp, Artificial sequence
  Synthetic oligonucleotide
ttcagcgaccagaatctaat

SEQ ID NO: 4112 - DNA, 20 bp, Artificial sequence
  Synthetic oligonucleotide
cttcagcgaccagaatctaa

SEQ ID NO: 4113 - DNA, 20 bp, Artificial sequence
  Synthetic oligonucleotide
ccttcagcgaccagaatcta

SEQ ID NO: 4114 - DNA, 20 bp, Artificial sequence
  Synthetic oligonucleotide
gccttcagcgaccagaatct

SEQ ID NO: 4115 - DNA, 20 bp, Artificial sequence
  Synthetic oligonucleotide
gaagttactaaagccttcag

SEQ ID NO: 4116 - DNA, 20 bp, Artificial sequence
  Synthetic oligonucleotide
ctgaagttactaaagccttc

SEQ ID NO: 4117 - DNA, 20 bp, Artificial sequence
  Synthetic oligonucleotide
tctgaagttactaaagcctt

SEQ ID NO: 4118 - DNA, 20 bp, Artificial sequence
  Synthetic oligonucleotide
ctctgaagttactaaagcct

SEQ ID NO: 4119 - DNA, 20 bp, Artificial sequence
  Synthetic oligonucleotide
actctgaagttactaaagcc

SEQ ID NO: 4120 - DNA, 20 bp, Artificial sequence
  Synthetic oligonucleotide
tactctgaagttactaaagc

SEQ ID NO: 4121 - DNA, 20 bp, Artificial sequence
  Synthetic oligonucleotide
ttactctgaagttactaaag

SEQ ID NO: 4122 - DNA, 20 bp, Artificial sequence
  Synthetic oligonucleotide
tttactctgaagttactaaa

SEQ ID NO: 4123 - DNA, 20 bp, Artificial sequence
  Synthetic oligonucleotide
ttttactctgaagttactaa

SEQ ID NO: 4124 - DNA, 20 bp, Artificial sequence
  Synthetic oligonucleotide
gttttactctgaagttacta

SEQ ID NO: 4125 - DNA, 20 bp, Artificial sequence
  Synthetic oligonucleotide
agttttactctgaagttact

SEQ ID NO: 4126 - DNA, 20 bp, Artificial sequence
  Synthetic oligonucleotide
aagttttactctgaagttac

SEQ ID NO: 4127 - DNA, 20 bp, Artificial sequence
  Synthetic oligonucleotide
caagttttactctgaagtta

SEQ ID NO: 4128 - DNA, 20 bp, Artificial sequence
  Synthetic oligonucleotide
tcaagttttactctgaagtt

SEQ ID NO: 4129 - DNA, 20 bp, Artificial sequence
  Synthetic oligonucleotide
tctcaagttttactctgaag

SEQ ID NO: 4130 - DNA, 20 bp, Artificial sequence
  Synthetic oligonucleotide
ctctcaagttttactctgaa

SEQ ID NO: 4131 - DNA, 20 bp, Artificial sequence
  Synthetic oligonucleotide
tctctcaagttttactctga

SEQ ID NO: 4132 - DNA, 20 bp, Artificial sequence
  Synthetic oligonucleotide
atctctcaagttttactctg

SEQ ID NO: 4133 - DNA, 20 bp, Artificial sequence
  Synthetic oligonucleotide
catctctcaagttttactct

SEQ ID NO: 4134 - DNA, 20 bp, Artificial sequence
  Synthetic oligonucleotide
tcatctctcaagttttactc

SEQ ID NO: 4135 - DNA, 20 bp, Artificial sequence
  Synthetic oligonucleotide
ctcatctctcaagttttact

SEQ ID NO: 4136 - DNA, 20 bp, Artificial sequence
  Synthetic oligonucleotide
tctcatctctcaagttttac

SEQ ID NO: 4137 - DNA, 20 bp, Artificial sequence
  Synthetic oligonucleotide
atctcatctctcaagtttta

SEQ ID NO: 4138 - DNA, 20 bp, Artificial sequence
  Synthetic oligonucleotide
catctcatctctcaagtttt

SEQ ID NO: 4139 - DNA, 20 bp, Artificial sequence
  Synthetic oligonucleotide
acatctcatctctcaagttt

SEQ ID NO: 4140 - DNA, 20 bp, Artificial sequence
  Synthetic oligonucleotide
tacatctcatctctcaagtt

SEQ ID NO: 4141 - DNA, 20 bp, Artificial sequence
  Synthetic oligonucleotide
ttacatctcatctctcaagt

SEQ ID NO: 4142 - DNA, 20 bp, Artificial sequence
  Synthetic oligonucleotide
tttacatctcatctctcaag

SEQ ID NO: 4143 - DNA, 20 bp, Artificial sequence
  Synthetic oligonucleotide
ttttacatctcatctctcaa

SEQ ID NO: 4144 - DNA, 20 bp, Artificial sequence
  Synthetic oligonucleotide
attttacatctcatctctca

SEQ ID NO: 4145 - DNA, 20 bp, Artificial sequence
  Synthetic oligonucleotide
cattttacatctcatctctc

SEQ ID NO: 4146 - DNA, 20 bp, Artificial sequence
  Synthetic oligonucleotide
gcattttacatctcatctct

SEQ ID NO: 4147 - DNA, 20 bp, Artificial sequence
  Synthetic oligonucleotide
tgcattttacatctcatctc

SEQ ID NO: 4148 - DNA, 20 bp, Artificial sequence
  Synthetic oligonucleotide
ctgcattttacatctcatct

SEQ ID NO: 4149 - DNA, 20 bp, Artificial sequence
  Synthetic oligonucleotide
gctgcattttacatctcatc

SEQ ID NO: 4150 - DNA, 20 bp, Artificial sequence
  Synthetic oligonucleotide
ggctgcattttacatctcat

SEQ ID NO: 4151 - DNA, 20 bp, Artificial sequence
  Synthetic oligonucleotide
tggctgcattttacatctca

SEQ ID NO: 4152 - DNA, 20 bp, Artificial sequence
  Synthetic oligonucleotide
atggctgcattttacatctc

SEQ ID NO: 4153 - DNA, 20 bp, Artificial sequence
  Synthetic oligonucleotide
aatggctgcattttacatct

SEQ ID NO: 4154 - DNA, 20 bp, Artificial sequence
  Synthetic oligonucleotide
gaatggctgcattttacatc

SEQ ID NO: 4155 - DNA, 20 bp, Artificial sequence
  Synthetic oligonucleotide
agaatggctgcattttacat

SEQ ID NO: 4156 - DNA, 20 bp, Artificial sequence
  Synthetic oligonucleotide
aagaatggctgcattttaca

SEQ ID NO: 4157 - DNA, 20 bp, Artificial sequence
  Synthetic oligonucleotide
caagaatggctgcattttac

SEQ ID NO: 4158 - DNA, 20 bp, Artificial sequence
  Synthetic oligonucleotide
tcaagaatggctgcatttta

SEQ ID NO: 4159 - DNA, 20 bp, Artificial sequence
  Synthetic oligonucleotide
ctcaagaatggctgcatttt

SEQ ID NO: 4160 - DNA, 20 bp, Artificial sequence
  Synthetic oligonucleotide
tctcaagaatggctgcattt

SEQ ID NO: 4161 - DNA, 20 bp, Artificial sequence
  Synthetic oligonucleotide
ctctcaagaatggctgcatt

SEQ ID NO: 4162 - DNA, 20 bp, Artificial sequence
  Synthetic oligonucleotide
actctcaagaatggctgcat

SEQ ID NO: 4163 - DNA, 20 bp, Artificial sequence
  Synthetic oligonucleotide
aactctcaagaatggctgca

SEQ ID NO: 4164 - DNA, 20 bp, Artificial sequence
  Synthetic oligonucleotide
gaactctcaagaatggctgc

SEQ ID NO: 4165 - DNA, 20 bp, Artificial sequence
  Synthetic oligonucleotide
ggaactctcaagaatggctg

SEQ ID NO: 4166 - DNA, 20 bp, Artificial sequence
  Synthetic oligonucleotide
aggaactctcaagaatggct

SEQ ID NO: 4167 - DNA, 20 bp, Artificial sequence
  Synthetic oligonucleotide
aaggaactctcaagaatggc

SEQ ID NO: 4168 - DNA, 20 bp, Artificial sequence
  Synthetic oligonucleotide
aaaggaactctcaagaatgg

SEQ ID NO: 4169 - DNA, 20 bp, Artificial sequence
  Synthetic oligonucleotide
aaaaggaactctcaagaatg

SEQ ID NO: 4170 - DNA, 20 bp, Artificial sequence
  Synthetic oligonucleotide
aaaaaggaactctcaagaat

SEQ ID NO: 4171 - DNA, 20 bp, Artificial sequence
  Synthetic oligonucleotide
gaaaaaggaactctcaagaa

SEQ ID NO: 4172 - DNA, 20 bp, Artificial sequence
  Synthetic oligonucleotide
agaaaaaggaactctcaaga

SEQ ID NO: 4173 - DNA, 20 bp, Artificial sequence
  Synthetic oligonucleotide
cagaaaaaggaactctcaag

SEQ ID NO: 4174 - DNA, 20 bp, Artificial sequence
  Synthetic oligonucleotide
acagaaaaaggaactctcaa

SEQ ID NO: 4175 - DNA, 20 bp, Artificial sequence
  Synthetic oligonucleotide
tacagaaaaaggaactctca

SEQ ID NO: 4176 - DNA, 20 bp, Artificial sequence
  Synthetic oligonucleotide
ttacagaaaaaggaactctc

SEQ ID NO: 4177 - DNA, 20 bp, Artificial sequence
  Synthetic oligonucleotide
gttacagaaaaaggaactct

SEQ ID NO: 4178 - DNA, 20 bp, Artificial sequence
  Synthetic oligonucleotide
tgttacagaaaaaggaactc

SEQ ID NO: 4179 - DNA, 20 bp, Artificial sequence
  Synthetic oligonucleotide
aatgttacagaaaaaggaac

SEQ ID NO: 4180 - DNA, 20 bp, Artificial sequence
  Synthetic oligonucleotide
gaatgttacagaaaaaggaa

SEQ ID NO: 4181 - DNA, 20 bp, Artificial sequence
  Synthetic oligonucleotide
tgaatgttacagaaaaagga

SEQ ID NO: 4182 - DNA, 20 bp, Artificial sequence
  Synthetic oligonucleotide
atgaatgttacagaaaaagg

SEQ ID NO: 4183 - DNA, 20 bp, Artificial sequence
  Synthetic oligonucleotide
gatgaatgttacagaaaaag

SEQ ID NO: 4184 - DNA, 20 bp, Artificial sequence
  Synthetic oligonucleotide
tgatgaatgttacagaaaaa

SEQ ID NO: 4185 - DNA, 20 bp, Artificial sequence
  Synthetic oligonucleotide
ttgatgaatgttacagaaaa

SEQ ID NO: 4186 - DNA, 20 bp, Artificial sequence
  Synthetic oligonucleotide
gttgatgaatgttacagaaa

SEQ ID NO: 4187 - DNA, 20 bp, Artificial sequence
  Synthetic oligonucleotide
tgttgatgaatgttacagaa

SEQ ID NO: 4188 - DNA, 20 bp, Artificial sequence
  Synthetic oligonucleotide
gtgttgatgaatgttacaga

SEQ ID NO: 4189 - DNA, 20 bp, Artificial sequence
  Synthetic oligonucleotide
agtgttgatgaatgttacag

SEQ ID NO: 4190 - DNA, 20 bp, Artificial sequence
  Synthetic oligonucleotide
aagtgttgatgaatgttaca

SEQ ID NO: 4191 - DNA, 20 bp, Artificial sequence
  Synthetic oligonucleotide
gaagtgttgatgaatgttac

SEQ ID NO: 4192 - DNA, 20 bp, Artificial sequence
  Synthetic oligonucleotide
tgaagtgttgatgaatgtta

SEQ ID NO: 4193 - DNA, 20 bp, Artificial sequence
  Synthetic oligonucleotide
atgaagtgttgatgaatgtt

SEQ ID NO: 4194 - DNA, 20 bp, Artificial sequence
  Synthetic oligonucleotide
aatgaagtgttgatgaatgt

SEQ ID NO: 4195 - DNA, 20 bp, Artificial sequence
  Synthetic oligonucleotide
caatgaagtgttgatgaatg

SEQ ID NO: 4196 - DNA, 20 bp, Artificial sequence
  Synthetic oligonucleotide
tcaatgaagtgttgatgaat

SEQ ID NO: 4197 - DNA, 20 bp, Artificial sequence
  Synthetic oligonucleotide
ctcaatgaagtgttgatgaa

SEQ ID NO: 4198 - DNA, 20 bp, Artificial sequence
  Synthetic oligonucleotide
tctcaatgaagtgttgatga

SEQ ID NO: 4199 - DNA, 20 bp, Artificial sequence
  Synthetic oligonucleotide
ttctcaatgaagtgttgatg

SEQ ID NO: 4200 - DNA, 20 bp, Artificial sequence
  Synthetic oligonucleotide
aaccttcacttctcaatgaa

SEQ ID NO: 4201 - DNA, 20 bp, Artificial sequence
  Synthetic oligonucleotide
gaaccttcacttctcaatga

SEQ ID NO: 4202 - DNA, 20 bp, Artificial sequence
  Synthetic oligonucleotide
ggaaccttcacttctcaatg

SEQ ID NO: 4203 - DNA, 20 bp, Artificial sequence
  Synthetic oligonucleotide
aggaaccttcacttctcaat

SEQ ID NO: 4204 - DNA, 20 bp, Artificial sequence
  Synthetic oligonucleotide
taggaaccttcacttctcaa

SEQ ID NO: 4205 - DNA, 20 bp, Artificial sequence
  Synthetic oligonucleotide
ataggaaccttcacttctca

SEQ ID NO: 4206 - DNA, 20 bp, Artificial sequence
  Synthetic oligonucleotide
cataggaaccttcacttctc

SEQ ID NO: 4207 - DNA, 20 bp, Artificial sequence
  Synthetic oligonucleotide
ccataggaaccttcacttct

SEQ ID NO: 4208 - DNA, 20 bp, Artificial sequence
  Synthetic oligonucleotide
gccataggaaccttcacttc

SEQ ID NO: 4209 - DNA, 20 bp, Artificial sequence
  Synthetic oligonucleotide
agccataggaaccttcactt

SEQ ID NO: 4210 - DNA, 20 bp, Artificial sequence
  Synthetic oligonucleotide
cagccataggaaccttcact

SEQ ID NO: 4211 - DNA, 20 bp, Artificial sequence
  Synthetic oligonucleotide
acagccataggaaccttcac

SEQ ID NO: 4212 - DNA, 20 bp, Artificial sequence
  Synthetic oligonucleotide
gacagccataggaaccttca

SEQ ID NO: 4213 - DNA, 20 bp, Artificial sequence
  Synthetic oligonucleotide
agacagccataggaaccttc

SEQ ID NO: 4214 - DNA, 20 bp, Artificial sequence
  Synthetic oligonucleotide
gagacagccataggaacctt

SEQ ID NO: 4215 - DNA, 20 bp, Artificial sequence
  Synthetic oligonucleotide
agagacagccataggaacct

SEQ ID NO: 4216 - DNA, 20 bp, Artificial sequence
  Synthetic oligonucleotide
tagagacagccataggaacc

SEQ ID NO: 4217 - DNA, 20 bp, Artificial sequence
  Synthetic oligonucleotide
gtagagacagccataggaac

SEQ ID NO: 4218 - DNA, 20 bp, Artificial sequence
  Synthetic oligonucleotide
ggtagagacagccataggaa

SEQ ID NO: 4219 - DNA, 20 bp, Artificial sequence
  Synthetic oligonucleotide
aggtagagacagccatagga

SEQ ID NO: 4220 - DNA, 20 bp, Artificial sequence
  Synthetic oligonucleotide
aaggtagagacagccatagg

SEQ ID NO: 4221 - DNA, 20 bp, Artificial sequence
  Synthetic oligonucleotide
gaaggtagagacagccatag

SEQ ID NO: 4222 - DNA, 20 bp, Artificial sequence
  Synthetic oligonucleotide
tgaaggtagagacagccata

SEQ ID NO: 4223 - DNA, 20 bp, Artificial sequence
  Synthetic oligonucleotide
ttgaaggtagagacagccat

SEQ ID NO: 4224 - DNA, 20 bp, Artificial sequence
  Synthetic oligonucleotide
cttgaaggtagagacagcca

SEQ ID NO: 4225 - DNA, 20 bp, Artificial sequence
  Synthetic oligonucleotide
tcttgaaggtagagacagcc

SEQ ID NO: 4226 - DNA, 20 bp, Artificial sequence
  Synthetic oligonucleotide
taaagctaagcctcttgaag

SEQ ID NO: 4227 - DNA, 20 bp, Artificial sequence
  Synthetic oligonucleotide
ctaaagctaagcctcttgaa

SEQ ID NO: 4228 - DNA, 20 bp, Artificial sequence
  Synthetic oligonucleotide
actaaagctaagcctcttga

SEQ ID NO: 4229 - DNA, 20 bp, Artificial sequence
  Synthetic oligonucleotide
gactaaagctaagcctcttg

SEQ ID NO: 4230 - DNA, 20 bp, Artificial sequence
  Synthetic oligonucleotide
tgactaaagctaagcctctt

SEQ ID NO: 4231 - DNA, 20 bp, Artificial sequence
  Synthetic oligonucleotide
gtgactaaagctaagcctct

SEQ ID NO: 4232 - DNA, 20 bp, Artificial sequence
  Synthetic oligonucleotide
agtgactaaagctaagcctc

SEQ ID NO: 4233 - DNA, 20 bp, Artificial sequence
  Synthetic oligonucleotide
cagtgactaaagctaagcct

SEQ ID NO: 4234 - DNA, 20 bp, Artificial sequence
  Synthetic oligonucleotide
tcagtgactaaagctaagcc

SEQ ID NO: 4235 - DNA, 20 bp, Artificial sequence
  Synthetic oligonucleotide
ctcagtgactaaagctaagc

SEQ ID NO: 4236 - DNA, 20 bp, Artificial sequence
  Synthetic oligonucleotide
tctcagtgactaaagctaag

SEQ ID NO: 4237 - DNA, 20 bp, Artificial sequence
  Synthetic oligonucleotide
ttctcagtgactaaagctaa

SEQ ID NO: 4238 - DNA, 20 bp, Artificial sequence
  Synthetic oligonucleotide
tttctcagtgactaaagcta

SEQ ID NO: 4239 - DNA, 20 bp, Artificial sequence
  Synthetic oligonucleotide
ctttctcagtgactaaagct

SEQ ID NO: 4240 - DNA, 20 bp, Artificial sequence
  Synthetic oligonucleotide
tctttctcagtgactaaagc

SEQ ID NO: 4241 - DNA, 20 bp, Artificial sequence
  Synthetic oligonucleotide
gtctttctcagtgactaaag

SEQ ID NO: 4242 - DNA, 20 bp, Artificial sequence
  Synthetic oligonucleotide
tgtctttctcagtgactaaa

SEQ ID NO: 4243 - DNA, 20 bp, Artificial sequence
  Synthetic oligonucleotide
ttgtctttctcagtgactaa

SEQ ID NO: 4244 - DNA, 20 bp, Artificial sequence
  Synthetic oligonucleotide
cttgtctttctcagtgacta

SEQ ID NO: 4245 - DNA, 20 bp, Artificial sequence
  Synthetic oligonucleotide
ccttgtctttctcagtgact

SEQ ID NO: 4246 - DNA, 20 bp, Artificial sequence
  Synthetic oligonucleotide
tccttgtctttctcagtgac

SEQ ID NO: 4247 - DNA, 20 bp, Artificial sequence
  Synthetic oligonucleotide
ttccttgtctttctcagtga

SEQ ID NO: 4248 - DNA, 20 bp, Artificial sequence
  Synthetic oligonucleotide
tttccttgtctttctcagtg

SEQ ID NO: 4249 - DNA, 20 bp, Artificial sequence
  Synthetic oligonucleotide
gtttccttgtctttctcagt

SEQ ID NO: 4250 - DNA, 20 bp, Artificial sequence
  Synthetic oligonucleotide
agtttccttgtctttctcag

SEQ ID NO: 4251 - DNA, 20 bp, Artificial sequence
  Synthetic oligonucleotide
tagtttccttgtctttctca

SEQ ID NO: 4252 - DNA, 20 bp, Artificial sequence
  Synthetic oligonucleotide
ttagtttccttgtctttctc

SEQ ID NO: 4253 - DNA, 20 bp, Artificial sequence
  Synthetic oligonucleotide
attagtttccttgtctttct

SEQ ID NO: 4254 - DNA, 20 bp, Artificial sequence
  Synthetic oligonucleotide
cattagtttccttgtctttc

SEQ ID NO: 4255 - DNA, 20 bp, Artificial sequence
  Synthetic oligonucleotide
tcattagtttccttgtcttt

SEQ ID NO: 4256 - DNA, 20 bp, Artificial sequence
  Synthetic oligonucleotide
atcattagtttccttgtctt

SEQ ID NO: 4257 - DNA, 20 bp, Artificial sequence
  Synthetic oligonucleotide
tatcattagtttccttgtct

SEQ ID NO: 4258 - DNA, 20 bp, Artificial sequence
  Synthetic oligonucleotide
ctatcattagtttccttgtc

SEQ ID NO: 4259 - DNA, 20 bp, Artificial sequence
  Synthetic oligonucleotide
tctatcattagtttccttgt

SEQ ID NO: 4260 - DNA, 20 bp, Artificial sequence
  Synthetic oligonucleotide
ttctatcattagtttccttg

SEQ ID NO: 4261 - DNA, 20 bp, Artificial sequence
  Synthetic oligonucleotide
attctatcattagtttcctt

SEQ ID NO: 4262 - DNA, 20 bp, Artificial sequence
  Synthetic oligonucleotide
tattctatcattagtttcct

SEQ ID NO: 4263 - DNA, 20 bp, Artificial sequence
  Synthetic oligonucleotide
atattctatcattagtttcc

SEQ ID NO: 4264 - DNA, 20 bp, Artificial sequence
  Synthetic oligonucleotide
ctactatattctatcattag

SEQ ID NO: 4265 - DNA, 20 bp, Artificial sequence
  Synthetic oligonucleotide
gctactatattctatcatta

SEQ ID NO: 4266 - DNA, 20 bp, Artificial sequence
  Synthetic oligonucleotide
agctactatattctatcatt

SEQ ID NO: 4267 - DNA, 20 bp, Artificial sequence
  Synthetic oligonucleotide
aagctactatattctatcat

SEQ ID NO: 4268 - DNA, 20 bp, Artificial sequence
  Synthetic oligonucleotide
gaagctactatattctatca

SEQ ID NO: 4269 - DNA, 20 bp, Artificial sequence
  Synthetic oligonucleotide
agaagctactatattctatc

SEQ ID NO: 4270 - DNA, 20 bp, Artificial sequence
  Synthetic oligonucleotide
aagaagctactatattctat

SEQ ID NO: 4271 - DNA, 20 bp, Artificial sequence
  Synthetic oligonucleotide
gaagaagctactatattcta

SEQ ID NO: 4272 - DNA, 20 bp, Artificial sequence
  Synthetic oligonucleotide
agaagaagctactatattct

SEQ ID NO: 4273 - DNA, 20 bp, Artificial sequence
  Synthetic oligonucleotide
cagaagaagctactatattc

SEQ ID NO: 4274 - DNA, 20 bp, Artificial sequence
  Synthetic oligonucleotide
ccagaagaagctactatatt

SEQ ID NO: 4275 - DNA, 20 bp, Artificial sequence
  Synthetic oligonucleotide
gccagaagaagctactatat

SEQ ID NO: 4276 - DNA, 20 bp, Artificial sequence
  Synthetic oligonucleotide
cgccagaagaagctactata

SEQ ID NO: 4277 - DNA, 20 bp, Artificial sequence
  Synthetic oligonucleotide
acgccagaagaagctactat

SEQ ID NO: 4278 - DNA, 20 bp, Artificial sequence
  Synthetic oligonucleotide
aacgccagaagaagctacta

SEQ ID NO: 4279 - DNA, 20 bp, Artificial sequence
  Synthetic oligonucleotide
taacgccagaagaagctact

SEQ ID NO: 4280 - DNA, 20 bp, Artificial sequence
  Synthetic oligonucleotide
ctaacgccagaagaagctac

SEQ ID NO: 4281 - DNA, 20 bp, Artificial sequence
  Synthetic oligonucleotide
cctaacgccagaagaagcta

SEQ ID NO: 4282 - DNA, 20 bp, Artificial sequence
  Synthetic oligonucleotide
acctaacgccagaagaagct

SEQ ID NO: 4283 - DNA, 20 bp, Artificial sequence
  Synthetic oligonucleotide
tacctaacgccagaagaagc

SEQ ID NO: 4284 - DNA, 20 bp, Artificial sequence
  Synthetic oligonucleotide
atacctaacgccagaagaag

SEQ ID NO: 4285 - DNA, 20 bp, Artificial sequence
  Synthetic oligonucleotide
gatacctaacgccagaagaa

SEQ ID NO: 4286 - DNA, 20 bp, Artificial sequence
  Synthetic oligonucleotide
tgatacctaacgccagaaga

SEQ ID NO: 4287 - DNA, 20 bp, Artificial sequence
  Synthetic oligonucleotide
gtgatacctaacgccagaag

SEQ ID NO: 4288 - DNA, 20 bp, Artificial sequence
  Synthetic oligonucleotide
tgtgatacctaacgccagaa

SEQ ID NO: 4289 - DNA, 20 bp, Artificial sequence
  Synthetic oligonucleotide
ctgtgatacctaacgccaga

SEQ ID NO: 4290 - DNA, 20 bp, Artificial sequence
  Synthetic oligonucleotide
tctgtgatacctaacgccag

SEQ ID NO: 4291 - DNA, 20 bp, Artificial sequence
  Synthetic oligonucleotide
ctctgtgatacctaacgcca

SEQ ID NO: 4292 - DNA, 20 bp, Artificial sequence
  Synthetic oligonucleotide
actctgtgatacctaacgcc

SEQ ID NO: 4293 - DNA, 20 bp, Artificial sequence
  Synthetic oligonucleotide
gactctgtgatacctaacgc

SEQ ID NO: 4294 - DNA, 20 bp, Artificial sequence
  Synthetic oligonucleotide
tgactctgtgatacctaacg

SEQ ID NO: 4295 - DNA, 20 bp, Artificial sequence
  Synthetic oligonucleotide
gtgactctgtgatacctaac

SEQ ID NO: 4296 - DNA, 20 bp, Artificial sequence
  Synthetic oligonucleotide
tgtgactctgtgatacctaa

SEQ ID NO: 4297 - DNA, 20 bp, Artificial sequence
  Synthetic oligonucleotide
ctgtgactctgtgataccta

SEQ ID NO: 4298 - DNA, 20 bp, Artificial sequence
  Synthetic oligonucleotide
gctgtgactctgtgatacct

SEQ ID NO: 4299 - DNA, 20 bp, Artificial sequence
  Synthetic oligonucleotide
agctgtgactctgtgatacc

SEQ ID NO: 4300 - DNA, 20 bp, Artificial sequence
  Synthetic oligonucleotide
tagctgtgactctgtgatac

SEQ ID NO: 4301 - DNA, 20 bp, Artificial sequence
  Synthetic oligonucleotide
ctagctgtgactctgtgata

SEQ ID NO: 4302 - DNA, 20 bp, Artificial sequence
  Synthetic oligonucleotide
actagctgtgactctgtgat

SEQ ID NO: 4303 - DNA, 20 bp, Artificial sequence
  Synthetic oligonucleotide
aactagctgtgactctgtga

SEQ ID NO: 4304 - DNA, 20 bp, Artificial sequence
  Synthetic oligonucleotide
taactagctgtgactctgtg

SEQ ID NO: 4305 - DNA, 20 bp, Artificial sequence
  Synthetic oligonucleotide
gtaactagctgtgactctgt

SEQ ID NO: 4306 - DNA, 20 bp, Artificial sequence
  Synthetic oligonucleotide
tgtaactagctgtgactctg

SEQ ID NO: 4307 - DNA, 20 bp, Artificial sequence
  Synthetic oligonucleotide
ctgtaactagctgtgactct

SEQ ID NO: 4308 - DNA, 20 bp, Artificial sequence
  Synthetic oligonucleotide
taaagggctagctgtaacta

SEQ ID NO: 4309 - DNA, 20 bp, Artificial sequence
  Synthetic oligonucleotide
ataaagggctagctgtaact

SEQ ID NO: 4310 - DNA, 20 bp, Artificial sequence
  Synthetic oligonucleotide
aataaagggctagctgtaac

SEQ ID NO: 4311 - DNA, 20 bp, Artificial sequence
  Synthetic oligonucleotide
taataaagggctagctgtaa

SEQ ID NO: 4312 - DNA, 20 bp, Artificial sequence
  Synthetic oligonucleotide
ataataaagggctagctgta

SEQ ID NO: 4313 - DNA, 20 bp, Artificial sequence
  Synthetic oligonucleotide
aataataaagggctagctgt

SEQ ID NO: 4314 - DNA, 20 bp, Artificial sequence
  Synthetic oligonucleotide
caataataaagggctagctg

SEQ ID NO: 4315 - DNA, 20 bp, Artificial sequence
  Synthetic oligonucleotide
tcaataataaagggctagct

SEQ ID NO: 4316 - DNA, 20 bp, Artificial sequence
  Synthetic oligonucleotide
ttcaataataaagggctagc

SEQ ID NO: 4317 - DNA, 20 bp, Artificial sequence
  Synthetic oligonucleotide
tttcaataataaagggctag

SEQ ID NO: 4318 - DNA, 20 bp, Artificial sequence
  Synthetic oligonucleotide
ctttcaataataaagggcta

SEQ ID NO: 4319 - DNA, 20 bp, Artificial sequence
  Synthetic oligonucleotide
tctttcaataataaagggct

SEQ ID NO: 4320 - DNA, 20 bp, Artificial sequence
  Synthetic oligonucleotide
ttctttcaataataaagggc

SEQ ID NO: 4321 - DNA, 20 bp, Artificial sequence
  Synthetic oligonucleotide
cttctttcaataataaaggg

SEQ ID NO: 4322 - DNA, 20 bp, Artificial sequence
  Synthetic oligonucleotide
tcttctttcaataataaagg

SEQ ID NO: 4323 - DNA, 20 bp, Artificial sequence
  Synthetic oligonucleotide
ctcttctttcaataataaag

SEQ ID NO: 4324 - DNA, 20 bp, Artificial sequence
  Synthetic oligonucleotide
cctcttctttcaataataaa

SEQ ID NO: 4325 - DNA, 20 bp, Artificial sequence
  Synthetic oligonucleotide
tcctcttctttcaataataa

SEQ ID NO: 4326 - DNA, 20 bp, Artificial sequence
  Synthetic oligonucleotide
ctcctcttctttcaataata

SEQ ID NO: 4327 - DNA, 20 bp, Artificial sequence
  Synthetic oligonucleotide
gctcctcttctttcaataat

SEQ ID NO: 4328 - DNA, 20 bp, Artificial sequence
  Synthetic oligonucleotide
agctcctcttctttcaataa

SEQ ID NO: 4329 - DNA, 20 bp, Artificial sequence
  Synthetic oligonucleotide
tagctcctcttctttcaata

SEQ ID NO: 4330 - DNA, 20 bp, Artificial sequence
  Synthetic oligonucleotide
ctagctcctcttctttcaat

SEQ ID NO: 4331 - DNA, 20 bp, Artificial sequence
  Synthetic oligonucleotide
gctagctcctcttctttcaa

SEQ ID NO: 4332 - DNA, 20 bp, Artificial sequence
  Synthetic oligonucleotide
tgctagctcctcttctttca

SEQ ID NO: 4333 - DNA, 20 bp, Artificial sequence
  Synthetic oligonucleotide
ctgctagctcctcttctttc

SEQ ID NO: 4334 - DNA, 20 bp, Artificial sequence
  Synthetic oligonucleotide
actgctagctcctcttcttt

SEQ ID NO: 4335 - DNA, 20 bp, Artificial sequence
  Synthetic oligonucleotide
gactgctagctcctcttctt

SEQ ID NO: 4336 - DNA, 20 bp, Artificial sequence
  Synthetic oligonucleotide
ggactgctagctcctcttct

SEQ ID NO: 4337 - DNA, 20 bp, Artificial sequence
  Synthetic oligonucleotide
tgggactgctagctcctctt

SEQ ID NO: 4338 - DNA, 20 bp, Artificial sequence
  Synthetic oligonucleotide
tagtgggactgctagctcct

SEQ ID NO: 4339 - DNA, 20 bp, Artificial sequence
  Synthetic oligonucleotide
atagtgggactgctagctcc

SEQ ID NO: 4340 - DNA, 20 bp, Artificial sequence
  Synthetic oligonucleotide
gatagtgggactgctagctc

SEQ ID NO: 4341 - DNA, 20 bp, Artificial sequence
  Synthetic oligonucleotide
tgatagtgggactgctagct

SEQ ID NO: 4342 - DNA, 20 bp, Artificial sequence
  Synthetic oligonucleotide
ctgatagtgggactgctagc

SEQ ID NO: 4343 - DNA, 20 bp, Artificial sequence
  Synthetic oligonucleotide
tctgatagtgggactgctag

SEQ ID NO: 4344 - DNA, 20 bp, Artificial sequence
  Synthetic oligonucleotide
ttctgatagtgggactgcta

SEQ ID NO: 4345 - DNA, 20 bp, Artificial sequence
  Synthetic oligonucleotide
attctgatagtgggactgct

SEQ ID NO: 4346 - DNA, 20 bp, Artificial sequence
  Synthetic oligonucleotide
aattctgatagtgggactgc

SEQ ID NO: 4347 - DNA, 20 bp, Artificial sequence
  Synthetic oligonucleotide
taattctgatagtgggactg

SEQ ID NO: 4348 - DNA, 20 bp, Artificial sequence
  Synthetic oligonucleotide
ttaattctgatagtgggact

SEQ ID NO: 4349 - DNA, 20 bp, Artificial sequence
  Synthetic oligonucleotide
cttaattctgatagtgggac

SEQ ID NO: 4350 - DNA, 20 bp, Artificial sequence
  Synthetic oligonucleotide
tcttaattctgatagtggga

SEQ ID NO: 4351 - DNA, 20 bp, Artificial sequence
  Synthetic oligonucleotide
gtcttaattctgatagtggg

SEQ ID NO: 4352 - DNA, 20 bp, Artificial sequence
  Synthetic oligonucleotide
agtcttaattctgatagtgg

SEQ ID NO: 4353 - DNA, 20 bp, Artificial sequence
  Synthetic oligonucleotide
tagtcttaattctgatagtg

SEQ ID NO: 4354 - DNA, 20 bp, Artificial sequence
  Synthetic oligonucleotide
ctagtcttaattctgatagt

SEQ ID NO: 4355 - DNA, 20 bp, Artificial sequence
  Synthetic oligonucleotide
tctagtcttaattctgatag

SEQ ID NO: 4356 - DNA, 20 bp, Artificial sequence
  Synthetic oligonucleotide
ctctagtcttaattctgata

SEQ ID NO: 4357 - DNA, 20 bp, Artificial sequence
  Synthetic oligonucleotide
tctctagtcttaattctgat

SEQ ID NO: 4358 - DNA, 20 bp, Artificial sequence
  Synthetic oligonucleotide
atctctagtcttaattctga

SEQ ID NO: 4359 - DNA, 20 bp, Artificial sequence
  Synthetic oligonucleotide
catctctagtcttaattctg

SEQ ID NO: 4360 - DNA, 20 bp, Artificial sequence
  Synthetic oligonucleotide
ccatctctagtcttaattct

SEQ ID NO: 4361 - DNA, 20 bp, Artificial sequence
  Synthetic oligonucleotide
accatctctagtcttaattc

SEQ ID NO: 4362 - DNA, 20 bp, Artificial sequence
  Synthetic oligonucleotide
taccatctctagtcttaatt

SEQ ID NO: 4363 - DNA, 20 bp, Artificial sequence
  Synthetic oligonucleotide
ttaccatctctagtcttaat

SEQ ID NO: 4364 - DNA, 20 bp, Artificial sequence
  Synthetic oligonucleotide
attaccatctctagtcttaa

SEQ ID NO: 4365 - DNA, 20 bp, Artificial sequence
  Synthetic oligonucleotide
tattaccatctctagtctta

SEQ ID NO: 4366 - DNA, 20 bp, Artificial sequence
  Synthetic oligonucleotide
ctattaccatctctagtctt

SEQ ID NO: 4367 - DNA, 20 bp, Artificial sequence
  Synthetic oligonucleotide
cctattaccatctctagtct

SEQ ID NO: 4368 - DNA, 20 bp, Artificial sequence
  Synthetic oligonucleotide
tcctattaccatctctagtc

SEQ ID NO: 4369 - DNA, 20 bp, Artificial sequence
  Synthetic oligonucleotide
ctcctattaccatctctagt

SEQ ID NO: 4370 - DNA, 20 bp, Artificial sequence
  Synthetic oligonucleotide
gctcctattaccatctctag

SEQ ID NO: 4371 - DNA, 20 bp, Artificial sequence
  Synthetic oligonucleotide
agctcctattaccatctcta

SEQ ID NO: 4372 - DNA, 20 bp, Artificial sequence
  Synthetic oligonucleotide
tagctcctattaccatctct

SEQ ID NO: 4373 - DNA, 20 bp, Artificial sequence
  Synthetic oligonucleotide
ctagctcctattaccatctc

SEQ ID NO: 4374 - DNA, 20 bp, Artificial sequence
  Synthetic oligonucleotide
actagctcctattaccatct

SEQ ID NO: 4375 - DNA, 20 bp, Artificial sequence
  Synthetic oligonucleotide
tactagctcctattaccatc

SEQ ID NO: 4376 - DNA, 20 bp, Artificial sequence
  Synthetic oligonucleotide
atactagctcctattaccat

SEQ ID NO: 4377 - DNA, 20 bp, Artificial sequence
  Synthetic oligonucleotide
gatactagctcctattacca

SEQ ID NO: 4378 - DNA, 20 bp, Artificial sequence
  Synthetic oligonucleotide
tgatactagctcctattacc

SEQ ID NO: 4379 - DNA, 20 bp, Artificial sequence
  Synthetic oligonucleotide
ctgatactagctcctattac

SEQ ID NO: 4380 - DNA, 20 bp, Artificial sequence
  Synthetic oligonucleotide
tctgatactagctcctatta

SEQ ID NO: 4381 - DNA, 20 bp, Artificial sequence
  Synthetic oligonucleotide
ttctgatactagctcctatt

SEQ ID NO: 4382 - DNA, 20 bp, Artificial sequence
  Synthetic oligonucleotide
tttctgatactagctcctat

SEQ ID NO: 4383 - DNA, 20 bp, Artificial sequence
  Synthetic oligonucleotide
ttttctgatactagctccta

SEQ ID NO: 4384 - DNA, 20 bp, Artificial sequence
  Synthetic oligonucleotide
cttttctgatactagctcct

SEQ ID NO: 4385 - DNA, 20 bp, Artificial sequence
  Synthetic oligonucleotide
gcttttctgatactagctcc

SEQ ID NO: 4386 - DNA, 20 bp, Artificial sequence
  Synthetic oligonucleotide
agcttttctgatactagctc

SEQ ID NO: 4387 - DNA, 20 bp, Artificial sequence
  Synthetic oligonucleotide
taagcttttctgatactagc

SEQ ID NO: 4388 - DNA, 20 bp, Artificial sequence
  Synthetic oligonucleotide
ttaagcttttctgatactag

SEQ ID NO: 4389 - DNA, 20 bp, Artificial sequence
  Synthetic oligonucleotide
cttaagcttttctgatacta

SEQ ID NO: 4390 - DNA, 20 bp, Artificial sequence
  Synthetic oligonucleotide
ccttaagcttttctgatact

SEQ ID NO: 4391 - DNA, 20 bp, Artificial sequence
  Synthetic oligonucleotide
actttatgctttgccttaag

SEQ ID NO: 4392 - DNA, 20 bp, Artificial sequence
  Synthetic oligonucleotide
cactttatgctttgccttaa

SEQ ID NO: 4393 - DNA, 20 bp, Artificial sequence
  Synthetic oligonucleotide
acactttatgctttgcctta

SEQ ID NO: 4394 - DNA, 20 bp, Artificial sequence
  Synthetic oligonucleotide
tacactttatgctttgcctt

SEQ ID NO: 4395 - DNA, 20 bp, Artificial sequence
  Synthetic oligonucleotide
ctacactttatgctttgcct

SEQ ID NO: 4396 - DNA, 20 bp, Artificial sequence
  Synthetic oligonucleotide
cctacactttatgctttgcc

SEQ ID NO: 4397 - DNA, 20 bp, Artificial sequence
  Synthetic oligonucleotide
gcctacactttatgctttgc

SEQ ID NO: 4398 - DNA, 20 bp, Artificial sequence
  Synthetic oligonucleotide
agcctacactttatgctttg

SEQ ID NO: 4399 - DNA, 20 bp, Artificial sequence
  Synthetic oligonucleotide
tagcctacactttatgcttt

SEQ ID NO: 4400 - DNA, 20 bp, Artificial sequence
  Synthetic oligonucleotide
ctagcctacactttatgctt

SEQ ID NO: 4401 - DNA, 20 bp, Artificial sequence
  Synthetic oligonucleotide
tctagcctacactttatgct

SEQ ID NO: 4402 - DNA, 20 bp, Artificial sequence
  Synthetic oligonucleotide
ttctagcctacactttatgc

SEQ ID NO: 4403 - DNA, 20 bp, Artificial sequence
  Synthetic oligonucleotide
attctagcctacactttatg

SEQ ID NO: 4404 - DNA, 20 bp, Artificial sequence
  Synthetic oligonucleotide
cattctagcctacactttat

SEQ ID NO: 4405 - DNA, 20 bp, Artificial sequence
  Synthetic oligonucleotide
tcattctagcctacacttta

SEQ ID NO: 4406 - DNA, 20 bp, Artificial sequence
  Synthetic oligonucleotide
ttcattctagcctacacttt

SEQ ID NO: 4407 - DNA, 20 bp, Artificial sequence
  Synthetic oligonucleotide
cttcattctagcctacactt

SEQ ID NO: 4408 - DNA, 20 bp, Artificial sequence
  Synthetic oligonucleotide
gcttcattctagcctacact

SEQ ID NO: 4409 - DNA, 20 bp, Artificial sequence
  Synthetic oligonucleotide
attctccagcttcattctag

SEQ ID NO: 4410 - DNA, 20 bp, Artificial sequence
  Synthetic oligonucleotide
cattctccagcttcattcta

SEQ ID NO: 4411 - DNA, 20 bp, Artificial sequence
  Synthetic oligonucleotide
ccattctccagcttcattct

SEQ ID NO: 4412 - DNA, 20 bp, Artificial sequence
  Synthetic oligonucleotide
cccattctccagcttcattc

SEQ ID NO: 4413 - DNA, 20 bp, Artificial sequence
  Synthetic oligonucleotide
ccccattctccagcttcatt

SEQ ID NO: 4414 - DNA, 20 bp, Artificial sequence
  Synthetic oligonucleotide
tccccattctccagcttcat

SEQ ID NO: 4415 - DNA, 20 bp, Artificial sequence
  Synthetic oligonucleotide
ctccccattctccagcttca

SEQ ID NO: 4416 - DNA, 20 bp, Artificial sequence
  Synthetic oligonucleotide
tctggatgttacccaagccc

SEQ ID NO: 4417 - DNA, 20 bp, Artificial sequence
  Synthetic oligonucleotide
ttctggatgttacccaagcc

SEQ ID NO: 4418 - DNA, 20 bp, Artificial sequence
  Synthetic oligonucleotide
gttctggatgttacccaagc

SEQ ID NO: 4419 - DNA, 20 bp, Artificial sequence
  Synthetic oligonucleotide
ggttctggatgttacccaag

SEQ ID NO: 4420 - DNA, 20 bp, Artificial sequence
  Synthetic oligonucleotide
aggttctggatgttacccaa

SEQ ID NO: 4421 - DNA, 20 bp, Artificial sequence
  Synthetic oligonucleotide
caggttctggatgttaccca

SEQ ID NO: 4422 - DNA, 20 bp, Artificial sequence
  Synthetic oligonucleotide
atgtagttccaggtccccag

SEQ ID NO: 4423 - DNA, 20 bp, Artificial sequence
  Synthetic oligonucleotide
catgtagttccaggtcccca

SEQ ID NO: 4424 - DNA, 20 bp, Artificial sequence
  Synthetic oligonucleotide
tcatgtagttccaggtcccc

SEQ ID NO: 4425 - DNA, 20 bp, Artificial sequence
  Synthetic oligonucleotide
ctcatgtagttccaggtccc

SEQ ID NO: 4426 - DNA, 20 bp, Artificial sequence
  Synthetic oligonucleotide
tctcatgtagttccaggtcc

SEQ ID NO: 4427 - DNA, 20 bp, Artificial sequence
  Synthetic oligonucleotide
atctcatgtagttccaggtc

SEQ ID NO: 4428 - DNA, 20 bp, Artificial sequence
  Synthetic oligonucleotide
catctcatgtagttccaggt

SEQ ID NO: 4429 - DNA, 20 bp, Artificial sequence
  Synthetic oligonucleotide
ctccattcttacatctcatg

SEQ ID NO: 4430 - DNA, 20 bp, Artificial sequence
  Synthetic oligonucleotide
tctccattcttacatctcat

SEQ ID NO: 4431 - DNA, 20 bp, Artificial sequence
  Synthetic oligonucleotide
ctctccattcttacatctca

SEQ ID NO: 4432 - DNA, 20 bp, Artificial sequence
  Synthetic oligonucleotide
cctctccattcttacatctc

SEQ ID NO: 4433 - DNA, 20 bp, Artificial sequence
  Synthetic oligonucleotide
acctctccattcttacatct

SEQ ID NO: 4434 - DNA, 20 bp, Artificial sequence
  Synthetic oligonucleotide
aacctctccattcttacatc

SEQ ID NO: 4435 - DNA, 20 bp, Artificial sequence
  Synthetic oligonucleotide
gaacctctccattcttacat

SEQ ID NO: 4436 - DNA, 20 bp, Artificial sequence
  Synthetic oligonucleotide
agaacctctccattcttaca

SEQ ID NO: 4437 - DNA, 20 bp, Artificial sequence
  Synthetic oligonucleotide
tagaacctctccattcttac

SEQ ID NO: 4438 - DNA, 20 bp, Artificial sequence
  Synthetic oligonucleotide
ctagaacctctccattctta

SEQ ID NO: 4439 - DNA, 20 bp, Artificial sequence
  Synthetic oligonucleotide
gctagaacctctccattctt

SEQ ID NO: 4440 - DNA, 20 bp, Artificial sequence
  Synthetic oligonucleotide
ctgctagaacctctccattc

SEQ ID NO: 4441 - DNA, 20 bp, Artificial sequence
  Synthetic oligonucleotide
actgctagaacctctccatt

SEQ ID NO: 4442 - DNA, 20 bp, Artificial sequence
  Synthetic oligonucleotide
gactgctagaacctctccat

SEQ ID NO: 4443 - DNA, 20 bp, Artificial sequence
  Synthetic oligonucleotide
tgactgctagaacctctcca

SEQ ID NO: 4444 - DNA, 20 bp, Artificial sequence
  Synthetic oligonucleotide
ctgactgctagaacctctcc

SEQ ID NO: 4445 - DNA, 20 bp, Artificial sequence
  Synthetic oligonucleotide
tctgactgctagaacctctc

SEQ ID NO: 4446 - DNA, 20 bp, Artificial sequence
  Synthetic oligonucleotide
ctctgactgctagaacctct

SEQ ID NO: 4447 - DNA, 20 bp, Artificial sequence
  Synthetic oligonucleotide
cctctgactgctagaacctc

SEQ ID NO: 4448 - DNA, 20 bp, Artificial sequence
  Synthetic oligonucleotide
acctctgactgctagaacct

SEQ ID NO: 4449 - DNA, 20 bp, Artificial sequence
  Synthetic oligonucleotide
gacctctgactgctagaacc

SEQ ID NO: 4450 - DNA, 20 bp, Artificial sequence
  Synthetic oligonucleotide
tgacctctgactgctagaac

SEQ ID NO: 4451 - DNA, 20 bp, Artificial sequence
  Synthetic oligonucleotide
ctgacctctgactgctagaa

SEQ ID NO: 4452 - DNA, 20 bp, Artificial sequence
  Synthetic oligonucleotide
cctgacctctgactgctaga

SEQ ID NO: 4453 - DNA, 20 bp, Artificial sequence
  Synthetic oligonucleotide
acctgacctctgactgctag

SEQ ID NO: 4454 - DNA, 20 bp, Artificial sequence
  Synthetic oligonucleotide
tacctgacctctgactgcta

SEQ ID NO: 4455 - DNA, 20 bp, Artificial sequence
  Synthetic oligonucleotide
gtacctgacctctgactgct

SEQ ID NO: 4456 - DNA, 20 bp, Artificial sequence
  Synthetic oligonucleotide
tgtacctgacctctgactgc

SEQ ID NO: 4457 - DNA, 20 bp, Artificial sequence
  Synthetic oligonucleotide
ttgtacctgacctctgactg

SEQ ID NO: 4458 - DNA, 20 bp, Artificial sequence
  Synthetic oligonucleotide
tttgtacctgacctctgact

SEQ ID NO: 4459 - DNA, 20 bp, Artificial sequence
  Synthetic oligonucleotide
atttgtacctgacctctgac

SEQ ID NO: 4460 - DNA, 20 bp, Artificial sequence
  Synthetic oligonucleotide
catttgtacctgacctctga

SEQ ID NO: 4461 - DNA, 20 bp, Artificial sequence
  Synthetic oligonucleotide
tcatttgtacctgacctctg

SEQ ID NO: 4462 - DNA, 20 bp, Artificial sequence
  Synthetic oligonucleotide
ttcatttgtacctgacctct

SEQ ID NO: 4463 - DNA, 20 bp, Artificial sequence
  Synthetic oligonucleotide
gttcatttgtacctgacctc

SEQ ID NO: 4464 - DNA, 20 bp, Artificial sequence
  Synthetic oligonucleotide
tgttcatttgtacctgacct

SEQ ID NO: 4465 - DNA, 20 bp, Artificial sequence
  Synthetic oligonucleotide
ctgttcatttgtacctgacc

SEQ ID NO: 4466 - DNA, 20 bp, Artificial sequence
  Synthetic oligonucleotide
gctgttcatttgtacctgac

SEQ ID NO: 4467 - DNA, 20 bp, Artificial sequence
  Synthetic oligonucleotide
agctgttcatttgtacctga

SEQ ID NO: 4468 - DNA, 20 bp, Artificial sequence
  Synthetic oligonucleotide
cagctgttcatttgtacctg

SEQ ID NO: 4469 - DNA, 20 bp, Artificial sequence
  Synthetic oligonucleotide
ccagctgttcatttgtacct

SEQ ID NO: 4470 - DNA, 20 bp, Artificial sequence
  Synthetic oligonucleotide
cccagctgttcatttgtacc

SEQ ID NO: 4471 - DNA, 20 bp, Artificial sequence
  Synthetic oligonucleotide
tcccagctgttcatttgtac

SEQ ID NO: 4472 - DNA, 20 bp, Artificial sequence
  Synthetic oligonucleotide
atcccagctgttcatttgta

SEQ ID NO: 4473 - DNA, 20 bp, Artificial sequence
  Synthetic oligonucleotide
gatcccagctgttcatttgt

SEQ ID NO: 4474 - DNA, 20 bp, Artificial sequence
  Synthetic oligonucleotide
agatcccagctgttcatttg

SEQ ID NO: 4475 - DNA, 20 bp, Artificial sequence
  Synthetic oligonucleotide
cagatcccagctgttcattt

SEQ ID NO: 4476 - DNA, 20 bp, Artificial sequence
  Synthetic oligonucleotide
gcagatcccagctgttcatt

SEQ ID NO: 4477 - DNA, 20 bp, Artificial sequence
  Synthetic oligonucleotide
cgcagatcccagctgttcat

SEQ ID NO: 4478 - DNA, 20 bp, Artificial sequence
  Synthetic oligonucleotide
atgcgcagatcccagctgtt

SEQ ID NO: 4479 - DNA, 20 bp, Artificial sequence
  Synthetic oligonucleotide
ttttcactgtctgccatgcg

SEQ ID NO: 4480 - DNA, 20 bp, Artificial sequence
  Synthetic oligonucleotide
tttttcactgtctgccatgc

SEQ ID NO: 4481 - DNA, 20 bp, Artificial sequence
  Synthetic oligonucleotide
ttttgcttgcctgggttttt

SEQ ID NO: 4482 - DNA, 20 bp, Artificial sequence
  Synthetic oligonucleotide
attttgcttgcctgggtttt

SEQ ID NO: 4483 - DNA, 20 bp, Artificial sequence
  Synthetic oligonucleotide
cattttgcttgcctgggttt

SEQ ID NO: 4484 - DNA, 20 bp, Artificial sequence
  Synthetic oligonucleotide
ccattttgcttgcctgggtt

SEQ ID NO: 4485 - DNA, 20 bp, Artificial sequence
  Synthetic oligonucleotide
accattttgcttgcctgggt

SEQ ID NO: 4486 - DNA, 20 bp, Artificial sequence
  Synthetic oligonucleotide
gaccattttgcttgcctggg

SEQ ID NO: 4487 - DNA, 20 bp, Artificial sequence
  Synthetic oligonucleotide
tgaccattttgcttgcctgg

SEQ ID NO: 4488 - DNA, 20 bp, Artificial sequence
  Synthetic oligonucleotide
ctgaccattttgcttgcctg

SEQ ID NO: 4489 - DNA, 20 bp, Artificial sequence
  Synthetic oligonucleotide
tctgaccattttgcttgcct

SEQ ID NO: 4490 - DNA, 20 bp, Artificial sequence
  Synthetic oligonucleotide
ctctgaccattttgcttgcc

SEQ ID NO: 4491 - DNA, 20 bp, Artificial sequence
  Synthetic oligonucleotide
gctctgaccattttgcttgc

SEQ ID NO: 4492 - DNA, 20 bp, Artificial sequence
  Synthetic oligonucleotide
tgctctgaccattttgcttg

SEQ ID NO: 4493 - DNA, 20 bp, Artificial sequence
  Synthetic oligonucleotide
ctgctctgaccattttgctt

SEQ ID NO: 4494 - DNA, 20 bp, Artificial sequence
  Synthetic oligonucleotide
tctgctctgaccattttgct

SEQ ID NO: 4495 - DNA, 20 bp, Artificial sequence
  Synthetic oligonucleotide
ttctgctctgaccattttgc

SEQ ID NO: 4496 - DNA, 20 bp, Artificial sequence
  Synthetic oligonucleotide
tttctgctctgaccattttg

SEQ ID NO: 4497 - DNA, 20 bp, Artificial sequence
  Synthetic oligonucleotide
ctttctgctctgaccatttt

SEQ ID NO: 4498 - DNA, 20 bp, Artificial sequence
  Synthetic oligonucleotide
cctttctgctctgaccattt

SEQ ID NO: 4499 - DNA, 20 bp, Artificial sequence
  Synthetic oligonucleotide
ccctttctgctctgaccatt

SEQ ID NO: 4500 - DNA, 20 bp, Artificial sequence
  Synthetic oligonucleotide
cccctttctgctctgaccat

SEQ ID NO: 4501 - DNA, 20 bp, Artificial sequence
  Synthetic oligonucleotide
catctcaagaacgtggcctt

SEQ ID NO: 4502 - DNA, 20 bp, Artificial sequence
  Synthetic oligonucleotide
acatctcaagaacgtggcct

SEQ ID NO: 4503 - DNA, 20 bp, Artificial sequence
  Synthetic oligonucleotide
cacatctcaagaacgtggcc

SEQ ID NO: 4504 - DNA, 20 bp, Artificial sequence
  Synthetic oligonucleotide
ctccacatctcaagaacgtg

SEQ ID NO: 4505 - DNA, 20 bp, Artificial sequence
  Synthetic oligonucleotide
cctccacatctcaagaacgt

SEQ ID NO: 4506 - DNA, 20 bp, Artificial sequence
  Synthetic oligonucleotide
ccctccacatctcaagaacg

SEQ ID NO: 4507 - DNA, 20 bp, Artificial sequence
  Synthetic oligonucleotide
cccctccacatctcaagaac

SEQ ID NO: 4508 - DNA, 20 bp, Artificial sequence
  Synthetic oligonucleotide
ccccctccacatctcaagaa

SEQ ID NO: 4509 - DNA, 20 bp, Artificial sequence
  Synthetic oligonucleotide
tacttggcgtggcttcctca

SEQ ID NO: 4510 - DNA, 20 bp, Artificial sequence
  Synthetic oligonucleotide
ttacttggcgtggcttcctc

SEQ ID NO: 4511 - DNA, 20 bp, Artificial sequence
  Synthetic oligonucleotide
cttacttggcgtggcttcct

SEQ ID NO: 4512 - DNA, 20 bp, Artificial sequence
  Synthetic oligonucleotide
tccttacttggcgtggcttc

SEQ ID NO: 4513 - DNA, 20 bp, Artificial sequence
  Synthetic oligonucleotide
gtccttacttggcgtggctt

SEQ ID NO: 4514 - DNA, 20 bp, Artificial sequence
  Synthetic oligonucleotide
tgtccttacttggcgtggct

SEQ ID NO: 4515 - DNA, 20 bp, Artificial sequence
  Synthetic oligonucleotide
tctgtccttacttggcgtgg

SEQ ID NO: 4516 - DNA, 20 bp, Artificial sequence
  Synthetic oligonucleotide
atctgtccttacttggcgtg

SEQ ID NO: 4517 - DNA, 20 bp, Artificial sequence
  Synthetic oligonucleotide
catctgtccttacttggcgt

SEQ ID NO: 4518 - DNA, 20 bp, Artificial sequence
  Synthetic oligonucleotide
gcatctgtccttacttggcg

SEQ ID NO: 4519 - DNA, 20 bp, Artificial sequence
  Synthetic oligonucleotide
tgcatctgtccttacttggc

SEQ ID NO: 4520 - DNA, 20 bp, Artificial sequence
  Synthetic oligonucleotide
ctgcatctgtccttacttgg

SEQ ID NO: 4521 - DNA, 20 bp, Artificial sequence
  Synthetic oligonucleotide
gctgcatctgtccttacttg

SEQ ID NO: 4522 - DNA, 20 bp, Artificial sequence
  Synthetic oligonucleotide
agctgcatctgtccttactt

SEQ ID NO: 4523 - DNA, 20 bp, Artificial sequence
  Synthetic oligonucleotide
gagctgcatctgtccttact

SEQ ID NO: 4524 - DNA, 20 bp, Artificial sequence
  Synthetic oligonucleotide
tgagctgcatctgtccttac

SEQ ID NO: 4525 - DNA, 20 bp, Artificial sequence
  Synthetic oligonucleotide
ctgagctgcatctgtcctta

SEQ ID NO: 4526 - DNA, 20 bp, Artificial sequence
  Synthetic oligonucleotide
gctgagctgcatctgtcctt

SEQ ID NO: 4527 - DNA, 20 bp, Artificial sequence
  Synthetic oligonucleotide
tgctgagctgcatctgtcct

SEQ ID NO: 4528 - DNA, 20 bp, Artificial sequence
  Synthetic oligonucleotide
ttgtcagggctcgctaggaa

SEQ ID NO: 4529 - DNA, 20 bp, Artificial sequence
  Synthetic oligonucleotide
actccactgtgccatgactg

SEQ ID NO: 4530 - DNA, 20 bp, Artificial sequence
  Synthetic oligonucleotide
cactccactgtgccatgact

SEQ ID NO: 4531 - DNA, 20 bp, Artificial sequence
  Synthetic oligonucleotide
tcactccactgtgccatgac

SEQ ID NO: 4532 - DNA, 20 bp, Artificial sequence
  Synthetic oligonucleotide
ttcactccactgtgccatga

SEQ ID NO: 4533 - DNA, 20 bp, Artificial sequence
  Synthetic oligonucleotide
cttcactccactgtgccatg

SEQ ID NO: 4534 - DNA, 20 bp, Artificial sequence
  Synthetic oligonucleotide
ccttcactccactgtgccat

SEQ ID NO: 4535 - DNA, 20 bp, Artificial sequence
  Synthetic oligonucleotide
tccttcactccactgtgcca

SEQ ID NO: 4536 - DNA, 20 bp, Artificial sequence
  Synthetic oligonucleotide
ttccttcactccactgtgcc

SEQ ID NO: 4537 - DNA, 20 bp, Artificial sequence
  Synthetic oligonucleotide
cttccttcactccactgtgc

SEQ ID NO: 4538 - DNA, 20 bp, Artificial sequence
  Synthetic oligonucleotide
ctcttccttcactccactgt

SEQ ID NO: 4539 - DNA, 20 bp, Artificial sequence
  Synthetic oligonucleotide
gctcttccttcactccactg

SEQ ID NO: 4540 - DNA, 20 bp, Artificial sequence
  Synthetic oligonucleotide
tgctcttccttcactccact

SEQ ID NO: 4541 - DNA, 20 bp, Artificial sequence
  Synthetic oligonucleotide
ctgctcttccttcactccac

SEQ ID NO: 4542 - DNA, 20 bp, Artificial sequence
  Synthetic oligonucleotide
actgctcttccttcactcca

SEQ ID NO: 4543 - DNA, 20 bp, Artificial sequence
  Synthetic oligonucleotide
aactgctcttccttcactcc

SEQ ID NO: 4544 - DNA, 20 bp, Artificial sequence
  Synthetic oligonucleotide
aaactgctcttccttcactc

SEQ ID NO: 4545 - DNA, 20 bp, Artificial sequence
  Synthetic oligonucleotide
gaaactgctcttccttcact

SEQ ID NO: 4546 - DNA, 20 bp, Artificial sequence
  Synthetic oligonucleotide
tgaaactgctcttccttcac

SEQ ID NO: 4547 - DNA, 20 bp, Artificial sequence
  Synthetic oligonucleotide
ctgaaactgctcttccttca

SEQ ID NO: 4548 - DNA, 20 bp, Artificial sequence
  Synthetic oligonucleotide
cctgaaactgctcttccttc

SEQ ID NO: 4549 - DNA, 20 bp, Artificial sequence
  Synthetic oligonucleotide
gcctgaaactgctcttcctt

SEQ ID NO: 4550 - DNA, 20 bp, Artificial sequence
  Synthetic oligonucleotide
tgcctgaaactgctcttcct

SEQ ID NO: 4551 - DNA, 20 bp, Artificial sequence
  Synthetic oligonucleotide
gtgcctgaaactgctcttcc

SEQ ID NO: 4552 - DNA, 20 bp, Artificial sequence
  Synthetic oligonucleotide
ggtgcctgaaactgctcttc

SEQ ID NO: 4553 - DNA, 20 bp, Artificial sequence
  Synthetic oligonucleotide
gggtgcctgaaactgctctt

SEQ ID NO: 4554 - DNA, 20 bp, Artificial sequence
  Synthetic oligonucleotide
tgggtgcctgaaactgctct

SEQ ID NO: 4555 - DNA, 20 bp, Artificial sequence
  Synthetic oligonucleotide
ttgggtgcctgaaactgctc

SEQ ID NO: 4556 - DNA, 20 bp, Artificial sequence
  Synthetic oligonucleotide
tttgggtgcctgaaactgct

SEQ ID NO: 4557 - DNA, 20 bp, Artificial sequence
  Synthetic oligonucleotide
ttttgggtgcctgaaactgc

SEQ ID NO: 4558 - DNA, 20 bp, Artificial sequence
  Synthetic oligonucleotide
gttttgggtgcctgaaactg

SEQ ID NO: 4559 - DNA, 20 bp, Artificial sequence
  Synthetic oligonucleotide
ggttttgggtgcctgaaact

SEQ ID NO: 4560 - DNA, 20 bp, Artificial sequence
  Synthetic oligonucleotide
aggttttgggtgcctgaaac

SEQ ID NO: 4561 - DNA, 20 bp, Artificial sequence
  Synthetic oligonucleotide
aggtggaaaacaggtcgtgg

SEQ ID NO: 4562 - DNA, 20 bp, Artificial sequence
  Synthetic oligonucleotide
caggtggaaaacaggtcgtg

SEQ ID NO: 4563 - DNA, 20 bp, Artificial sequence
  Synthetic oligonucleotide
tcaggtggaaaacaggtcgt

SEQ ID NO: 4564 - DNA, 20 bp, Artificial sequence
  Synthetic oligonucleotide
ttcaggtggaaaacaggtcg

SEQ ID NO: 4565 - DNA, 20 bp, Artificial sequence
  Synthetic oligonucleotide
cttcaggtggaaaacaggtc

SEQ ID NO: 4566 - DNA, 20 bp, Artificial sequence
  Synthetic oligonucleotide
tcttcaggtggaaaacaggt

SEQ ID NO: 4567 - DNA, 20 bp, Artificial sequence
  Synthetic oligonucleotide
ctcttcaggtggaaaacagg

SEQ ID NO: 4568 - DNA, 20 bp, Artificial sequence
  Synthetic oligonucleotide
gctcttcaggtggaaaacag

SEQ ID NO: 4569 - DNA, 20 bp, Artificial sequence
  Synthetic oligonucleotide
ggctcttcaggtggaaaaca

SEQ ID NO: 4570 - DNA, 20 bp, Artificial sequence
  Synthetic oligonucleotide
tggctcttcaggtggaaaac

SEQ ID NO: 4571 - DNA, 20 bp, Artificial sequence
  Synthetic oligonucleotide
gtggctcttcaggtggaaaa

SEQ ID NO: 4572 - DNA, 20 bp, Artificial sequence
  Synthetic oligonucleotide
ggtggctcttcaggtggaaa

SEQ ID NO: 4573 - DNA, 20 bp, Artificial sequence
  Synthetic oligonucleotide
aatgggtggctcttcaggtg

SEQ ID NO: 4574 - DNA, 20 bp, Artificial sequence
  Synthetic oligonucleotide
gaatgggtggctcttcaggt

SEQ ID NO: 4575 - DNA, 20 bp, Artificial sequence
  Synthetic oligonucleotide
tggaatgggtggctcttcag

SEQ ID NO: 4576 - DNA, 20 bp, Artificial sequence
  Synthetic oligonucleotide
atggaatgggtggctcttca

SEQ ID NO: 4577 - DNA, 20 bp, Artificial sequence
  Synthetic oligonucleotide
gatggaatgggtggctcttc

SEQ ID NO: 4578 - DNA, 20 bp, Artificial sequence
  Synthetic oligonucleotide
ggatggaatgggtggctctt

SEQ ID NO: 4579 - DNA, 20 bp, Artificial sequence
  Synthetic oligonucleotide
tggatggaatgggtggctct

SEQ ID NO: 4580 - DNA, 20 bp, Artificial sequence
  Synthetic oligonucleotide
ttggatggaatgggtggctc

SEQ ID NO: 4581 - DNA, 20 bp, Artificial sequence
  Synthetic oligonucleotide
tttggatggaatgggtggct

SEQ ID NO: 4582 - DNA, 20 bp, Artificial sequence
  Synthetic oligonucleotide
gtttggatggaatgggtggc

SEQ ID NO: 4583 - DNA, 20 bp, Artificial sequence
  Synthetic oligonucleotide
ggtttggatggaatgggtgg

SEQ ID NO: 4584 - DNA, 20 bp, Artificial sequence
  Synthetic oligonucleotide
gggtttggatggaatgggtg

SEQ ID NO: 4585 - DNA, 20 bp, Artificial sequence
  Synthetic oligonucleotide
agggtttggatggaatgggt

SEQ ID NO: 4586 - DNA, 20 bp, Artificial sequence
  Synthetic oligonucleotide
aagggtttggatggaatggg

SEQ ID NO: 4587 - DNA, 20 bp, Artificial sequence
  Synthetic oligonucleotide
caagggtttggatggaatgg

SEQ ID NO: 4588 - DNA, 20 bp, Artificial sequence
  Synthetic oligonucleotide
agacttttgccaagggtttg

SEQ ID NO: 4589 - DNA, 20 bp, Artificial sequence
  Synthetic oligonucleotide
cagacttttgccaagggttt

SEQ ID NO: 4590 - DNA, 20 bp, Artificial sequence
  Synthetic oligonucleotide
gcagacttttgccaagggtt

SEQ ID NO: 4591 - DNA, 20 bp, Artificial sequence
  Synthetic oligonucleotide
gccggttctctctgttagca

SEQ ID NO: 4592 - DNA, 20 bp, Artificial sequence
  Synthetic oligonucleotide
tggccggttctctctgttag

SEQ ID NO: 4593 - DNA, 20 bp, Artificial sequence
  Synthetic oligonucleotide
ctggccggttctctctgtta

SEQ ID NO: 4594 - DNA, 20 bp, Artificial sequence
  Synthetic oligonucleotide
actggccggttctctctgtt

SEQ ID NO: 4595 - DNA, 20 bp, Artificial sequence
  Synthetic oligonucleotide
tactggccggttctctctgt

SEQ ID NO: 4596 - DNA, 20 bp, Artificial sequence
  Synthetic oligonucleotide
atactggccggttctctctg

SEQ ID NO: 4597 - DNA, 20 bp, Artificial sequence
  Synthetic oligonucleotide
catactggccggttctctct

SEQ ID NO: 4598 - DNA, 20 bp, Artificial sequence
  Synthetic oligonucleotide
agcatactggccggttctct

SEQ ID NO: 4599 - DNA, 20 bp, Artificial sequence
  Synthetic oligonucleotide
agacaggcatgatcgcgact

SEQ ID NO: 4600 - DNA, 20 bp, Artificial sequence
  Synthetic oligonucleotide
aagacaggcatgatcgcgac

SEQ ID NO: 4601 - DNA, 20 bp, Artificial sequence
  Synthetic oligonucleotide
aaagacaggcatgatcgcga

SEQ ID NO: 4602 - DNA, 20 bp, Artificial sequence
  Synthetic oligonucleotide
taaagacaggcatgatcgcg

SEQ ID NO: 4603 - DNA, 20 bp, Artificial sequence
  Synthetic oligonucleotide
gtaaagacaggcatgatcgc

SEQ ID NO: 4604 - DNA, 20 bp, Artificial sequence
  Synthetic oligonucleotide
ggtaaagacaggcatgatcg

SEQ ID NO: 4605 - DNA, 20 bp, Artificial sequence
  Synthetic oligonucleotide
gggtaaagacaggcatgatc

SEQ ID NO: 4606 - DNA, 20 bp, Artificial sequence
  Synthetic oligonucleotide
agggtaaagacaggcatgat

SEQ ID NO: 4607 - DNA, 20 bp, Artificial sequence
  Synthetic oligonucleotide
gagggtaaagacaggcatga

SEQ ID NO: 4608 - DNA, 20 bp, Artificial sequence
  Synthetic oligonucleotide
agagggtaaagacaggcatg

SEQ ID NO: 4609 - DNA, 20 bp, Artificial sequence
  Synthetic oligonucleotide
tagagggtaaagacaggcat

SEQ ID NO: 4610 - DNA, 20 bp, Artificial sequence
  Synthetic oligonucleotide
ttagagggtaaagacaggca

SEQ ID NO: 4611 - DNA, 20 bp, Artificial sequence
  Synthetic oligonucleotide
cttagagggtaaagacaggc

SEQ ID NO: 4612 - DNA, 20 bp, Artificial sequence
  Synthetic oligonucleotide
gcttagagggtaaagacagg

SEQ ID NO: 4613 - DNA, 20 bp, Artificial sequence
  Synthetic oligonucleotide
agcttagagggtaaagacag

SEQ ID NO: 4614 - DNA, 20 bp, Artificial sequence
  Synthetic oligonucleotide
cagcttagagggtaaagaca

SEQ ID NO: 4615 - DNA, 20 bp, Artificial sequence
  Synthetic oligonucleotide
tcagcttagagggtaaagac

SEQ ID NO: 4616 - DNA, 20 bp, Artificial sequence
  Synthetic oligonucleotide
ttcagcttagagggtaaaga

SEQ ID NO: 4617 - DNA, 20 bp, Artificial sequence
  Synthetic oligonucleotide
cttcagcttagagggtaaag

SEQ ID NO: 4618 - DNA, 20 bp, Artificial sequence
  Synthetic oligonucleotide
ccgttgatgagcagcttcag

SEQ ID NO: 4619 - DNA, 20 bp, Artificial sequence
  Synthetic oligonucleotide
accgttgatgagcagcttca

SEQ ID NO: 4620 - DNA, 20 bp, Artificial sequence
  Synthetic oligonucleotide
caccgttgatgagcagcttc

SEQ ID NO: 4621 - DNA, 20 bp, Artificial sequence
  Synthetic oligonucleotide
tcaccgttgatgagcagctt

SEQ ID NO: 4622 - DNA, 20 bp, Artificial sequence
  Synthetic oligonucleotide
ctcaccgttgatgagcagct

SEQ ID NO: 4623 - DNA, 20 bp, Artificial sequence
  Synthetic oligonucleotide
tttgccatctcaccgttgat

SEQ ID NO: 4624 - DNA, 20 bp, Artificial sequence
  Synthetic oligonucleotide
ttttgccatctcaccgttga

SEQ ID NO: 4625 - DNA, 20 bp, Artificial sequence
  Synthetic oligonucleotide
tttttgccatctcaccgttg

SEQ ID NO: 4626 - DNA, 20 bp, Artificial sequence
  Synthetic oligonucleotide
ctttttgccatctcaccgtt

SEQ ID NO: 4627 - DNA, 20 bp, Artificial sequence
  Synthetic oligonucleotide
cctttttgccatctcaccgt

SEQ ID NO: 4628 - DNA, 20 bp, Artificial sequence
  Synthetic oligonucleotide
acctttttgccatctcaccg

SEQ ID NO: 4629 - DNA, 20 bp, Artificial sequence
  Synthetic oligonucleotide
cacctttttgccatctcacc

SEQ ID NO: 4630 - DNA, 20 bp, Artificial sequence
  Synthetic oligonucleotide
ccacctttttgccatctcac

SEQ ID NO: 4631 - DNA, 20 bp, Artificial sequence
  Synthetic oligonucleotide
cccacctttttgccatctca

SEQ ID NO: 4632 - DNA, 20 bp, Artificial sequence
  Synthetic oligonucleotide
acccacctttttgccatctc

SEQ ID NO: 4633 - DNA, 20 bp, Artificial sequence
  Synthetic oligonucleotide
gacccacctttttgccatct

SEQ ID NO: 4634 - DNA, 20 bp, Artificial sequence
  Synthetic oligonucleotide
ggacccacctttttgccatc

SEQ ID NO: 4635 - DNA, 20 bp, Artificial sequence
  Synthetic oligonucleotide
tttcccctcttctggaccca

SEQ ID NO: 4636 - DNA, 20 bp, Artificial sequence
  Synthetic oligonucleotide
ttttcccctcttctggaccc

SEQ ID NO: 4637 - DNA, 20 bp, Artificial sequence
  Synthetic oligonucleotide
cttttcccctcttctggacc

SEQ ID NO: 4638 - DNA, 20 bp, Artificial sequence
  Synthetic oligonucleotide
tcttttcccctcttctggac

SEQ ID NO: 4639 - DNA, 20 bp, Artificial sequence
  Synthetic oligonucleotide
ttcttttcccctcttctgga

SEQ ID NO: 4640 - DNA, 20 bp, Artificial sequence
  Synthetic oligonucleotide
cttcttttcccctcttctgg

SEQ ID NO: 4641 - DNA, 20 bp, Artificial sequence
  Synthetic oligonucleotide
ccttcttttcccctcttctg

SEQ ID NO: 4642 - DNA, 20 bp, Artificial sequence
  Synthetic oligonucleotide
cccttcttttcccctcttct

SEQ ID NO: 4643 - DNA, 20 bp, Artificial sequence
  Synthetic oligonucleotide
tcccttcttttcccctcttc

SEQ ID NO: 4644 - DNA, 20 bp, Artificial sequence
  Synthetic oligonucleotide
ctcccttcttttcccctctt

SEQ ID NO: 4645 - DNA, 20 bp, Artificial sequence
  Synthetic oligonucleotide
actcccttcttttcccctct

SEQ ID NO: 4646 - DNA, 20 bp, Artificial sequence
  Synthetic oligonucleotide
gactcccttcttttcccctc

SEQ ID NO: 4647 - DNA, 20 bp, Artificial sequence
  Synthetic oligonucleotide
agactcccttcttttcccct

SEQ ID NO: 4648 - DNA, 20 bp, Artificial sequence
  Synthetic oligonucleotide
cagactcccttcttttcccc

SEQ ID NO: 4649 - DNA, 20 bp, Artificial sequence
  Synthetic oligonucleotide
acagactcccttcttttccc

SEQ ID NO: 4650 - DNA, 20 bp, Artificial sequence
  Synthetic oligonucleotide
cacagactcccttcttttcc

SEQ ID NO: 4651 - DNA, 20 bp, Artificial sequence
  Synthetic oligonucleotide
tcacagactcccttcttttc

SEQ ID NO: 4652 - DNA, 20 bp, Artificial sequence
  Synthetic oligonucleotide
ttcacagactcccttctttt

SEQ ID NO: 4653 - DNA, 20 bp, Artificial sequence
  Synthetic oligonucleotide
tttcacagactcccttcttt

SEQ ID NO: 4654 - DNA, 20 bp, Artificial sequence
  Synthetic oligonucleotide
ttttcacagactcccttctt

SEQ ID NO: 4655 - DNA, 20 bp, Artificial sequence
  Synthetic oligonucleotide
gttttcacagactcccttct

SEQ ID NO: 4656 - DNA, 20 bp, Artificial sequence
  Synthetic oligonucleotide
tgttttcacagactcccttc

SEQ ID NO: 4657 - DNA, 20 bp, Artificial sequence
  Synthetic oligonucleotide
ttgttttcacagactccctt

SEQ ID NO: 4658 - DNA, 20 bp, Artificial sequence
  Synthetic oligonucleotide
tttgttttcacagactccct

SEQ ID NO: 4659 - DNA, 20 bp, Artificial sequence
  Synthetic oligonucleotide
ttttgttttcacagactccc

SEQ ID NO: 4660 - DNA, 20 bp, Artificial sequence
  Synthetic oligonucleotide
attttgttttcacagactcc

SEQ ID NO: 4661 - DNA, 20 bp, Artificial sequence
  Synthetic oligonucleotide
cattttgttttcacagactc

SEQ ID NO: 4662 - DNA, 20 bp, Artificial sequence
  Synthetic oligonucleotide
gcattttgttttcacagact

SEQ ID NO: 4663 - DNA, 20 bp, Artificial sequence
  Synthetic oligonucleotide
agcattttgttttcacagac

SEQ ID NO: 4664 - DNA, 20 bp, Artificial sequence
  Synthetic oligonucleotide
cagcattttgttttcacaga

SEQ ID NO: 4665 - DNA, 20 bp, Artificial sequence
  Synthetic oligonucleotide
tcagcattttgttttcacag

SEQ ID NO: 4666 - DNA, 20 bp, Artificial sequence
  Synthetic oligonucleotide
ttcagcattttgttttcaca

SEQ ID NO: 4667 - DNA, 20 bp, Artificial sequence
  Synthetic oligonucleotide
cttcagcattttgttttcac

SEQ ID NO: 4668 - DNA, 20 bp, Artificial sequence
  Synthetic oligonucleotide
tcttcagcattttgttttca

SEQ ID NO: 4669 - DNA, 20 bp, Artificial sequence
  Synthetic oligonucleotide
ttcttcagcattttgttttc

SEQ ID NO: 4670 - DNA, 20 bp, Artificial sequence
  Synthetic oligonucleotide
attcttcagcattttgtttt

SEQ ID NO: 4671 - DNA, 20 bp, Artificial sequence
  Synthetic oligonucleotide
gattcttcagcattttgttt

SEQ ID NO: 4672 - DNA, 20 bp, Artificial sequence
  Synthetic oligonucleotide
agattcttcagcattttgtt

SEQ ID NO: 4673 - DNA, 20 bp, Artificial sequence
  Synthetic oligonucleotide
cagattcttcagcattttgt

SEQ ID NO: 4674 - DNA, 20 bp, Artificial sequence
  Synthetic oligonucleotide
gcagattcttcagcattttg

SEQ ID NO: 4675 - DNA, 20 bp, Artificial sequence
  Synthetic oligonucleotide
tgcagattcttcagcatttt

SEQ ID NO: 4676 - DNA, 20 bp, Artificial sequence
  Synthetic oligonucleotide
tttgatgcagattcttcagc

SEQ ID NO: 4677 - DNA, 20 bp, Artificial sequence
  Synthetic oligonucleotide
atttgatgcagattcttcag

SEQ ID NO: 4678 - DNA, 20 bp, Artificial sequence
  Synthetic oligonucleotide
tatttgatgcagattcttca

SEQ ID NO: 4679 - DNA, 20 bp, Artificial sequence
  Synthetic oligonucleotide
ttatttgatgcagattcttc

SEQ ID NO: 4680 - DNA, 20 bp, Artificial sequence
  Synthetic oligonucleotide
tttatttgatgcagattctt

SEQ ID NO: 4681 - DNA, 20 bp, Artificial sequence
  Synthetic oligonucleotide
gtttatttgatgcagattct

SEQ ID NO: 4682 - DNA, 20 bp, Artificial sequence
  Synthetic oligonucleotide
ggtttatttgatgcagattc

SEQ ID NO: 4683 - DNA, 20 bp, Artificial sequence
  Synthetic oligonucleotide
gggtttatttgatgcagatt

SEQ ID NO: 4684 - DNA, 20 bp, Artificial sequence
  Synthetic oligonucleotide
agggtttatttgatgcagat

SEQ ID NO: 4685 - DNA, 20 bp, Artificial sequence
  Synthetic oligonucleotide
aagggtttatttgatgcaga

SEQ ID NO: 4686 - DNA, 20 bp, Artificial sequence
  Synthetic oligonucleotide
gaagggtttatttgatgcag

SEQ ID NO: 4687 - DNA, 20 bp, Artificial sequence
  Synthetic oligonucleotide
ggaagggtttatttgatgca

SEQ ID NO: 4688 - DNA, 20 bp, Artificial sequence
  Synthetic oligonucleotide
aggaagggtttatttgatgc

SEQ ID NO: 4689 - DNA, 20 bp, Artificial sequence
  Synthetic oligonucleotide
aaggaagggtttatttgatg

SEQ ID NO: 4690 - DNA, 20 bp, Artificial sequence
  Synthetic oligonucleotide
gaaggaagggtttatttgat

SEQ ID NO: 4691 - DNA, 20 bp, Artificial sequence
  Synthetic oligonucleotide
ggaaggaagggtttatttga

SEQ ID NO: 4692 - DNA, 20 bp, Artificial sequence
  Synthetic oligonucleotide
aggaaggaagggtttatttg

SEQ ID NO: 4693 - DNA, 20 bp, Artificial sequence
  Synthetic oligonucleotide
aaggaaggaagggtttattt

SEQ ID NO: 4694 - DNA, 20 bp, Artificial sequence
  Synthetic oligonucleotide
gaaggaaggaagggtttatt

SEQ ID NO: 4695 - DNA, 20 bp, Artificial sequence
  Synthetic oligonucleotide
ggaaggaaggaagggtttat

SEQ ID NO: 4696 - DNA, 20 bp, Artificial sequence
  Synthetic oligonucleotide
aggaaggaaggaagggttta

SEQ ID NO: 4697 - DNA, 20 bp, Artificial sequence
  Synthetic oligonucleotide
aaggaaggaaggaagggttt

SEQ ID NO: 4698 - DNA, 20 bp, Artificial sequence
  Synthetic oligonucleotide
aaaggaaggaaggaagggtt

SEQ ID NO: 4699 - DNA, 20 bp, Artificial sequence
  Synthetic oligonucleotide
aaaaggaaggaaggaagggt

SEQ ID NO: 4700 - DNA, 20 bp, Artificial sequence
  Synthetic oligonucleotide
aaaaaggaaggaaggaaggg

SEQ ID NO: 4701 - DNA, 20 bp, Artificial sequence
  Synthetic oligonucleotide
gaaaaaggaaggaaggaagg

SEQ ID NO: 4702 - DNA, 20 bp, Artificial sequence
  Synthetic oligonucleotide
ggaaaaaggaaggaaggaag

SEQ ID NO: 4703 - DNA, 20 bp, Artificial sequence
  Synthetic oligonucleotide
aggaaaaaggaaggaaggaa

SEQ ID NO: 4704 - DNA, 20 bp, Artificial sequence
  Synthetic oligonucleotide
aaggaaaaaggaaggaagga

SEQ ID NO: 4705 - DNA, 20 bp, Artificial sequence
  Synthetic oligonucleotide
gaaggaaaaaggaaggaagg

SEQ ID NO: 4706 - DNA, 20 bp, Artificial sequence
  Synthetic oligonucleotide
tgaaggaaaaaggaaggaag

SEQ ID NO: 4707 - DNA, 20 bp, Artificial sequence
  Synthetic oligonucleotide
ttgaaggaaaaaggaaggaa

SEQ ID NO: 4708 - DNA, 20 bp, Artificial sequence
  Synthetic oligonucleotide
tttgaaggaaaaaggaagga

SEQ ID NO: 4709 - DNA, 20 bp, Artificial sequence
  Synthetic oligonucleotide
ttttgaaggaaaaaggaagg

SEQ ID NO: 4710 - DNA, 20 bp, Artificial sequence
  Synthetic oligonucleotide
tttttgaaggaaaaaggaag

SEQ ID NO: 4711 - protein, 16 aa, Artificial Sequence
  RFGF
AAVALLPAVLLALLAP

SEQ ID NO: 4712 - protein, 11 aa, Artificial Sequence
  RFGF
AALLPVLLAAP

SEQ ID NO: 4713 - protein, 13 aa, Artificial Sequence
  HIV Tat
GRKKRRQRRRPPQ

SEQ ID NO: 4714 - protein, 16 aa, Artificial Sequence
  Drosophila Antennapedia
RQIKIWFQNRRMKWKK

---

The invention claimed is:

1. A single-stranded oligonucleotide of 20 linked nucleosides wherein the nucleobase sequence consists of SEQ ID NO: 515, 1302, or 2491, wherein all thymidines at positions 1-5 and 16-20 of the nucleobase sequence are substituted with 5-methyl-2'-O-methoxyethyl-uridine and all cytidines at positions 6-15 are substituted with 5-methyl-2'-O-methoxyethyl-cytidine, and wherein the backbone is fully phosphorothioate-modified.

2. The oligonucleotide of claim 1, further comprising a pseudouridine or 5-methoxyuridine.

3. The oligonucleotide of claim 1, further comprising an alternative sugar moiety, wherein the alternative sugar moiety is 2'-O-methyl or a bicyclic nucleic acid.

4. A pharmaceutical composition comprising the oligonucleotide of claim 1 and a pharmaceutically acceptable carrier or excipient.

5. A method of treating, preventing, or delaying the progression of a trinucleotide repeat expansion disorder in a subject in need thereof, the method comprising administering the oligonucleotide of claim 1 to the subject.

6. The method of claim 5, wherein the trinucleotide repeat expansion disorder is a polyglutamine disease.

7. The method of claim 5, wherein the trinucleotide repeat expansion disorder is a non-polyglutamine disease.

8. A method of preventing or delaying the progression of a trinucleotide repeat expansion disorder in a subject, the method comprising administering to the subject an oligonucleotide of claim 1 in an amount effective to delay progression of a trinucleotide repeat expansion disorder of the subject.

9. The method of claim 8, wherein the trinucleotide repeat expansion disorder is selected from the group consisting of dentatorubropallidoluysian atrophy, Huntington's disease, spinal and bulbar muscular atrophy, spinocerebellar ataxia type 1, spinocerebellar ataxia type 2, spinocerebellar ataxia type 3, spinocerebellar ataxia type 6, spinocerebellar ataxia type 7, spinocerebellar ataxia type 17, Huntington's disease-like 2, fragile X syndrome, fragile X-associated tremor/ataxia syndrome, fragile XE mental retardation, Friedreich's ataxia, myotonic dystrophy type 1, spinocerebellar ataxia type 8, spinocerebellar ataxia type 12, oculopharyngeal muscular dystrophy, Fragile X-associated premature ovarian failure, FRA2A syndrome, FRA7A syndrome, and early infantile epileptic encephalopathy.

* * * * *